United States Patent 11,446,398 (REGULATED BIOCIRCUIT SYSTEMS) - sequence listing, part 24

SEQ ID NO: 104739 - DNA, 5913 bp, Homo sapiens
  Payload ID: 565
  Gene Symbol: ADAMTS18
  Gene Name: ADAM metallopeptidase with thrombospondin type 1 motif, 18
  Uniprot ID: Q8TE60
  ENST ID: ENST00000282849
  CDS Start-End: 420-4085
aatcaccgcgcggtggagaggcgggcgctcggctccggcgcgctgggggagccagctggcgctgtcttccccatcgcctcagacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatatgctcccaagcctcccacagaggacacctatctaaggtttgatgaatatgggagctctgggcgacccagaagatcagctggaaaatcacaaaagggcctcaatgtggaaaccctcgtggtggcagacaagaaaatggtggaaaagcatggcaagggaaatgtcaccacatacattctcacagtaatgaacatggtttctggcctatttaaagatgggactattggaagtgacataaacgtggttgtggtgagcctaattcttctggaacaagaacctggaggattattgatcaaccatcatgcagaccagtctctgaatagtttttgtcaatggcagtctgccctcattggaaagaatggcaagagacatgatcatgccatcttactaacaggatttgatatttgttcttggaagaatgaaccatgtgacactctagggtttgcccccatcagtggaatgtgctctaagtaccgaagttgtaccatcaatgaggacacaggacttggccttgccttcaccatcgctcatgagtcagggcacaactttggtatgattcacgatggagaagggaatccctgcagaaaggctgaaggcaatatcatgtctcccacactgaccggaaacaatggagtgttttcatggtcttcctgcagccgccagtatctcaagaaattcctcagcacacctcaggcggggtgtctagtggatgagcccaagcaagcaggacagtataaatatccggacaaactaccaggacagatttatgatgctgacacacagtgtaaatggcaatttggagcaaaagccaagttatgcagccttggttttgtgaaggatatttgcaaatcactttggtgccaccgagtaggccacaggtgtgagaccaagtttatgcccgcagcagaagggaccgtttgtggcttgagtatgtggtgtcggcaaggccagtgcgtaaagtttggggagctcgggccccggcccatccacggccagtggtccgcctggtcgaagtggtcagaatgttcccggacatgtggtggaggagtcaagttccaggagagacactgcaataaccccaagcctcagtatggtggcttattctgtccaggttctagccgtatttatcagctgtgcaatattaacccttgcaatgaaaatagcttggattttcgggctcaacagtgtgcagaatataacagcaaacctttccgtggatggttctaccagtggaaaccctatacaaaagtggaagaggaagatcgatgcaaactgtactgcaaggctgagaactttgaatttttttttgcaatgtccggcaaagtgaaagatggaactccctgctccccaaacaaaaatgatgtttgtattgacggggtttgtgaactagtgggatgtgatcatgaactaggctctaaagcagtttcagatgcttgtggcgtttgcaaaggtgataattcaacttgcaagttttataaaggcctgtacctcaaccagcataaagcaaatgaatattatccggtggtcctcattccagctggcgcccgaagcatcgaaatccaggagctgcaggtttcctccagttacctcgcagttcgaagcctcagtcaaaagtattacctcaccgggggctggagcatcgactggcctggggagttccccttcgctgggaccacgtttgaataccagcgctctttcaaccgcccggaacgtctgtacgcgccagggcccacaaatgagacgctggtctttgaaattctgatgcaaggcaaaaatccagggatagcttggaagtatgcacttcccaaggtcatgaatggaactccaccagccacaaaaagacctgcctatacctggagtatcgtgcagtcagagtgctccgtctcctgtggtggaggttacataaatgtaaaggccatttgcttgcgagatcaaaatactcaagtcaattcctcattctgcagtgcaaaaaccaagccagtaactgagcccaaaatctgcaacgctttctcctgcccggcttactggatgccaggtgaatggagtacatgcagcaaggcctgtgctggaggccagcagagccgaaagatccagtgtgtgcaaaagaagcccttccaaaaggaggaagcagtgttgcattctctctgtccagtgagcacacccactcaggtccaagcctgcaacagccatgcctgccctccacaatggagccttggaccctggtctcagtgttccaagacctgtggacgaggggtgaggaagcgtgaactcctctgcaagggctctgccgcagaaaccctccccgagagccagtgtaccagtctccccagacctgagctgcaggagggctgtgtgcttggacgatgccccaagaacagccggctacagtgggtcgcttcttcgtggagcgagtgttctgcaacctgtggtttgggtgtgaggaagagggagatgaagtgcagcgagaagggcttccagggaaagctgataactttcccagagcgaagatgccgtaatattaagaaaccaaatctggacttggaagagacctgcaaccgacgggcttgcccagcccatccagtgtacaacatggtagctggatggtattcattgccgtggcagcagtgcacagtcacctgtgggggaggggtccagacccggtcagtccactgtgttcagcaaggccggccttcctcaagttgtctgctccatcagaaacctccggtgctacgagcctgtaatacaaacttctgtccagctcctgaaaagagagaggatccatcctgcgtagatttcttcaactggtgtcacctagttcctcagcatggtgtctgcaaccacaagttttacggaaaacaatgctgcaagtcatgcacaaggaagatctgatcttggtgtcctccccagcaccttagggccaggggcttacctttcaacctctagagagaccagctgcctttgagaccaggagctgagcaccgagaaccatctgtgagctgccgctgtgatgaaggagcctgctctgaggaacagacaggttgccagtaggcttctagctcaattccctgaagcacgtggtactctgaagcacttgaaaatgggaagcgatgacaaatctgactttaaaaaaaatctttgatttgcactgttatatgcaagaagtggtgaatcacactgagatacgtcgatttggggagagacccccttttgaacttcaaagggttcaagggcaaagacatctgttttaaaaaggtcctttatgacttcaggtcaaagactgagactcagaactttcaaatctggatggaataccttgcctaactgttgcgtggagttcacagttcgactaaccctgtgaacacccaagccaggagttctatgagaagccaaatggtgctcgcaattgtgcttgctgctggactggcaagcttcatgttatgtttatttggtgtgcgtgtgtctttattattttgtgtaaactatattctgcttatagagagtctctgagactaaaattgacaacttgaaaagtattccaaggaatattatgaaaatagggcaacatggactgtttaagatctccatgtaattgaaattcatgcaaggaaacaactcatagaaaagataaatatggatgcccttcacatgttatcaacctcgtaacttttggtgcttgctgaatcagtccatgaaaagctacagcccgctctttgggaatgctacatacccatttctggtatttaaaaaatatctaggaggagctaaatgacaaaacacagcagtgttttgagggagaaaggaccatcatttataatgctctgtacatactaccagagctgcttggaaaattaaaggccacttgtggctttttcctaccaactgatacgtttaaatttgccctaggattgagctaacagcaaaaaaaaaaaaaaaaaaaagagagaaagaaaggagtaaacagtggtaataaaaaaatccatctgtcttcttgctatgttaatattaataaatcataatatgacaagaccctcactgaataagagtattttcagtcatcagaagccagctgttggtaggcattaatgagtttaaaattgttctcaattgaaaaaacatcacactattttgccaaaaccaaagtaattataatactgtgtcctcctgtaattttttgagaagtggttataaagggcatatttacataaattctactttattcctcaacttctttgatgaatgtaacccaattttacttctttaaaaagtctcaattcaagctggattagccagctcagcataatcaactagacagtggtttgttaaatttagcagcatacttcgttcccattctaattaaagtcatgagttcttgaatcccagagaaataatgcttaggaacttctctcaatctgcttggcttggcctagagaagtggccattttatcaacaggaaaaaaaaaaattttctctactacaaccccgttgccttctgaaaaacagcaagttatttctttatataattatcattttattattttatggaaaattaatttattaattaatagcctattatgtgttctcacttgcttctctaagtaatattttgagataaaatgttgaataaaaccatggattatagagaaaagtcaaaatatatgtgtaatatttaattattttataagttttataataaagtattccatttctttatctttga

SEQ ID NO: 104740 - DNA, 1632 bp, Homo sapiens
  Payload ID: 565
  Gene Symbol: ADAMTS18
  Gene Name: ADAM metallopeptidase with thrombospondin type 1 motif, 18
  ENST ID: ENST00000449265
  CDS Start-End: 340-1164
agacgctcacaccgacacagacagacgcacagacgggcgggcagacaccgacagtctcccaaccgtttgcgctccagtcccggcccagggagccccccgtaccctctggggtgccgcaaactgcagctcggcaggcccgcgccgggagaagggagggcgcgcaggcggccggaggaggggaggtcccagcgcgcccccgctgcgatgtgaacggcggcggctctcacctggagccgcacctggggcgccgagctccggggccgcggaaagaatgcgcgccgcccgtgcgctccgcctgccgcgtctggccacccgcagccgccgcgtccgcacctgaccatggagtgcgccctcctgctcgcgtgtgccttcccggctgcgggttcgggcccgccgaggggcctggcgggactggggcgcgtggccaaggcgctccagctgtgctgcctctgctgtgcgtcggtcgccgcggccttagccagtgacagcagcagcggcgccagcggattaaatgatgattacgtctttgtcacgccagtagaagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgtcaggtttaataaggacacgaaaaaatgaattcctcatctcgccattacctcagcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatgtatatgctcccaagcctcccacagaggacacctatctaaggtttgatgaatatgggagctctgggcgacccagaagatcagctggaaaatcacaaaagggcctcaatgtggaaaccctcgtggtggcagacaagaaaatggtggaaaagcatggcaagggaaatgtcaccacatacattctcacagtaatgaacatggtttctggcctatttaaagatgggactattggaagtgacataaacgtggttgtggtgagcctaattcttctggaacaagaacctggtttgcccccatcagtggaatgtgctctaagtaccgaagttgtaccatcaatgaggacacaggacttggccttgccttcaccatcgctcatgagtcagggcacaactttggtatgattcacgatggagaagggaatccctgcagaaaggctgaaggcaatatcatgtctcccacactgaccggaaacaatggagtgttttcatggtcttcctgcagccgccagtatctcaag

SEQ ID NO: 104741 - DNA, 349 bp, Homo sapiens
  Payload ID: 565
  Gene Symbol: ADAMTS18
  Gene Name: ADAM metallopeptidase with thrombospondin type 1 motif, 18
  ENST ID: ENST00000562332
  CDS Start-End: 1-188
agcaaggccggccttcctcaagttgtctgctccatcagaaacctccggtgctacgagcctgtaatacaaacttctgtccagctcctgaaaagagagattctgcaggaagccagttaccatgttgtgatggtcctcaagcagtccatgaagaaggactgaggtttcctgacaaccactgggctatgtgagaaagccttccagaagcagattccccagcccagccgagtattcagataactacagccccacctccaatctttcttgcagcctgatgagagacctcaagccagaaccacacagctaaccatttctgaatttccatgcaataaatgcataatgttataagcca

SEQ ID NO: 104742 - DNA, 556 bp, Homo sapiens
  Payload ID: 565
  Gene Symbol: ADAMTS18
  Gene Name: ADAM metallopeptidase with thrombospondin type 1 motif, 18
  ENST ID: ENST00000562345
  CDS Start-End: 1-556
aagtagactcagccgggtcatatatttcacacgacattttgcacaacggcaggaaaaagcgatcggcgcagaatgccagaagctccctgcactaccgattttcagcatttggacaggaactgcacttagaacttaagccctcggcgattttgagcagtcactttattgtccaggtacttggaaaagatggtgcttcagagactcagaaacccgaggtgcagcaatgcttctatcagggatttatcagaaatgacagctcctcctctgtcgctgtgtctacgtgtgctggcttgcttctggcccaggaacacaactacagctcccctgcgggtcaccatcctcacgtactgtacaaaaggacagcagaggagaagatccagcggtaccgtggctaccccggctctggccggaattatcctggttactccccaagtcacattccccatgcatctcagagtcgagagacagagtatcaccatcgaaggttgcaaaagcagcatttttgtggacgacgcaagaaatgtatatgctcccaagcctcccacagaggacacct

SEQ ID NO: 104743 - DNA, 5234 bp, Homo sapiens
  Payload ID: 566
  Gene Symbol: ADAMTS19
  Gene Name: ADAM metallopeptidase with thrombospondin type 1 motif, 19
  Uniprot ID: Q8TE59
  ENST ID: ENST00000274487
  CDS Start-End: 146-3769
ggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaaccgcgagatgcgcctgactcacatctgctgctgctgcctcctttaccagctggggttcctgtcgaatgggatcgtttcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctgatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtatttaaccttttccaacacaagagtctgagtgtgcaggtcaatcttcgtgtgataaagcttattctgctccatgaaactccaccagaactatatattgggcatcatggagaaaaaatgctagagagtttttgtaagtggcaacatgaagaatttggcaaaaagaatgatatacatttagagatgtcaacaaactggggggaagacatgacttcagtggatgcagctatacttataacaaggaaagatttctgtgtgcacaaagatgaaccatgtgatactgttggtatagcttacttgagtggaatgtgtagtgaaaagagaaaatgtattattgctgaagacaatggcttgaatcttgcttttacaattgctcatgaaatgggtcacaacatgggcattaaccatgacaatgaccacccatcgtgtgctgatggtcttcatatcatgtctggtgaatggattaaaggacagaatcttggtgacgtttcatggtctcgatgtagcaaggaagatttggaaagatttctcaggtcaaaggccagtaactgcttgctacaaacaaatccgcagagtgtcaattctgtgatggttccctccaagctgccagggatgacatacactgctgatgaacaatgccagatcctttttgggccattggcttctttttgtcaggagatgcagcatgttatttgcacaggattatggtgcaaggtagaaggtgagaaagaatgcagaaccaagctagacccaccaatggatggaactgactgtgaccttggtaagtggtgtaaggctggagaatgtaccagcaggacctcagcacctgaacatctggccggagagtggagcctgtggagtccttgtagccgaacctgcagtgctgggatcagcagtcgagagcgcaaatgtcctgggctagattctgaagcaagggattgtaatggtcccagaaaacaatacagaatatgtgagaatccaccttgtcctgcaggtttgcctggattcagagactggcaatgtcaggcttatagtgttagaacttcctccccaaagcatatacttcagtggcaagctgtcctggatgaagaaaaaccatgtgccttgttttgctctcctgttggaaaagaacagcctattcttctatcagaaaaagtgatggatggaacttcttgtggctatcagggattagatatctgtgcaaatggcaggtgccagaaagttggctgtgatggtttattagggtctcttgcaagagaagatcattgtggtgtatgcaatggcaatggaaaatcatgcaagatcattaaaggggattttaatcacaccagaggagcaggttatgtagaagtgctggtgatacctgctggagcaagaagaatcaaagttgtggaggaaaagccggcacatagctatttagctctccgagatgctggcaaacagtctattaatagtgactggaagattgaacactctggagccttcaatttggctggaactaccgttcattatgtaagacgaggcctctgggagaagatctctgccaaaggtcctactacagcacctttacatcttctggtgctcctgtttcaggatcagaattatggtcttcactatgaatacactatcccatcagaccctcttccagaaaaccagagctctaaagcacctgagcccctcttcatgtggacacacacaagctgggaagattgcgatgccacttgtggaggaggagaaaggaagacaacagtgtcctgcacaaaaatcatgagcaaaaatatcagcattgtggacaatgagaaatgcaaatacttaaccaagccagagccacagattcgaaagtgcaatgagcaaccatgtcaaacaaggtggatgatgacagaatggaccccttgttcacgaacttgtggaaaaggaatgcagagcagacaagtggcctgtacccaacaactgagcaatggaacactgattagagcccgagagagggactgcattgggcccaagcccgcctctgcccagcgctgtgagggccaggactgcatgaccgtgtgggaggcgggagtgtggtctgagtgttcagtcaagtgtggcaaaggcatacgtcatcggaccgttagatgtaccaacccaagaaagaagtgtgtcctctctaccagacccagggaggctgaagactgtgaggattattcaaaatgctatgtgtggcgaatgggtgactggtctaagtgctcaattacctgtggcaaaggaatgcagtcccgtgtaatccaatgcatgcataagatcacaggaagacatggaaatgaatgtttttcctcagaaaaacctgcagcatacaggccatgccatcttcaaccctgcaatgagaaaattaatgtaaataccataacatcacccagactggctgctctgactttcaagtgcctgggagatcagtggccagtgtactgccgagtgatacgtgaaaagaacctatgtcaggacatgcggtggtatcagcgctgctgtgaaacatgcagggacttctatgcccaaaagctgcagcagaagagttgacctctagcaggctggctggatcacagctcttggcaattacattatttataaacacacacactagcatgtttttcagaccaaatattatcagattacatataatttaatcaaattaatttatttttttgcctgccaaacatccaatgtggtgcttgttttggttacacaaacattttgatttatactatatggcttcataaataattttatatgaatgaattagttggatccagtaatataataaaaagaaaaaggaaaaaaatagatcattatacttaaaacaagttttcgttgtttgttagggctatctctaaggtgctactctctccccaccaataacattgaattatccagaatgtatactgacttagcataatagtttaggtgtatatgaagagaaactatttttgttttttggtgtcctgctgcagaattagcccattttctgtcacctgcaggagatgtgtaaacataatgaacctcatgctgttgaacaggtttttagagaatgtattatgaatttggttcagatttatagacatccataggaaaaattctgctgtaattataaccttattttgatatggaaaagaaaagtcaaaatagagactttgatcatgttcatgaacatgtacttgaacacaagtattgtaacaatgaaacactgtaatgatttacactgaatcacaattgcactgttgatatagtgtagagaaatcgttagaaatggtgacatcttacaaaaaatgtgtattattttaacatgttatcactagattttagctttttttaaatatttttaacaaagaaaacattgatccacccatttccctgtatctttttagcagatttattaaagagtatagtacttagcctcacgaatcataattagaaaatttactagtatttctcagccttttccctaggaacaaggaaaaacagaaagcatataatacggtggtcgtttcattgtgtttttcttccttttaaaaattaaaaagttttacaattatgtgaaacgttcaaaagccagcttaaaatttttcttgtgagaaaatattatacatgattcacatgatttcttagatttttcaataaaatatgtaaaacttcccactgagagacaattcttcatagacttgtcacatatccacatgtctgatgaacaaaggtactgtctacttttgttctggagtatcttctagaggatgtttatagagtgaactgccttggaagatagtatgtctcttgggagcaaagggcaaacatacttctcattataaaagtttcaggttccctaaaattggggtttctttactataagacaatccaatgtatgttctgaggtcacctggctctcttcatgtcaccctttgggaaatggggctcaacgagccagtacaggaaaagctgattccctggctactactatcgctgtgagtaataaagtcctttgtgtctaatg

SEQ ID NO: 104744 - DNA, 588 bp, Homo sapiens
  Payload ID: 566
  Gene Symbol: ADAMTS19
  Gene Name: ADAM metallopeptidase with thrombospondin type 1 motif, 19
  ENST ID: ENST00000502709
  CDS Start-End: 1-436
agacgcaggctgcttctacaccggagctgtgctgcggcaccctggctcgctggcttctttcagcacctgtggaggtggcctgatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtaggcaaactttaaagtgcgcttggaattttttcaagaaaactctaaggaagacatgtgtatttaaccttttccaacacaagagtctgagtgtgcaggtcaatcttcgtgtgataaagcttattctgctccatgaaactccaccagaactatatattgggcatcat

SEQ ID NO: 104745 - DNA, 684 bp, Homo sapiens
  Payload ID: 566
  Gene Symbol: ADAMTS19
  Gene Name: ADAM metallopeptidase with thrombospondin type 1 motif, 19
  ENST ID: ENST00000505791
  CDS Start-End: 130-225
gggcaaattcgccgcccggcctcctagcgctccggggaggccgctgcgccccggagtggatcgcgctggaggcgtgcgccgggcgagaagccgcggccgcgggagcgcagtatggggaagaaccgcgagatgcgcctgactcacatctgctgctgctgcctcctttaccagctggggttcctgtcgaatgggatcgtttcagatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtaggcaaactttaaagtgcgcttggaattttttcaagaaaactctaaggaagacatgtgtatttaaccttttccaacacaagagtctgagtgtgcaggtcaatcttcgtgtgataaagcttattctgctccatgaaactcca

SEQ ID NO: 104746 - DNA, 6754 bp, Homo sapiens
  Payload ID: 567
  Gene Symbol: ADAMTS2
  Gene Name: ADAM metallopeptidase with thrombospondin type 1 motif, 2
  Uniprot ID: O95450
  ENST ID: ENST00000251582
  CDS Start-End: 103-3738
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtgcaatcctgcctctgtaattaggaaacggagcccgaggctttccattgttggttgaacccaggacagctggtgctattcacaggctgaagaactgggcagttcttacttgggtctgtcctaggatgtggaggaagttcaggactaacgctaggcagagagtatgactcggtttacccagcctaggggcctctggatgggaacactccattccaagatctcagcagagcagggcttcctggcttgaggctggaagcctttgggaagaggcccagctgggacattccctgggcacctgtcttccgctgaagggagcaaggtgccctctgggactgacagccatgaccctctgtgccatcctcaatccttgagccatatatcaagagtcctctagagccggatggtcctcaaaagtctgtccaaggaatgccaacgttcaccgggctctgagaaacgacgcaaatctctgagctggggaccacttggagaaccggcttagtaacagtcctgatcttcgcaagccagcttcttctgcatctgaggggctcctggcgcccagaggaggcagacagatgtcttctagctgagtttctaaccgcatgatgagactcagaccttccgctgcactagaaaatctgcaacagtgtccctgagtcacttctccttagtgggcagactcgtgttagatttgtggaacccagctctctgatttactccttttggaaaacccatggaatttcatgtataaggctttcatttgtattttaaggtttttctgtttgttttgagtatatacatggtgctcaatagcaacatcttagcagatgaagcagtttatgattccactccctcctgtatgacaggtagccactatactgaatcaaggtgctgaactcaaatcacaaaattctggcttaccgatacaacaaccaatacatctttgttctgtaatgtaaaatttgactccttacttttataacttattaaagttaaaatgtctgtgtttttgcaaatcatg

SEQ ID NO: 104747 - DNA, 2044 bp, Homo sapiens
  Payload ID: 567
  Gene Symbol: ADAMTS2
  Gene Name: ADAM metallopeptidase with thrombospondin type 1 motif, 2
  Uniprot ID: O95450
  ENST ID: ENST00000274609
  CDS Start-End: 103-1803
agctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgca

SEQ ID NO: 104748 - DNA, 6076 bp, Homo sapiens
  Payload ID: 568
  Gene Symbol: ADAMTS20
  Gene Name: ADAM metallopeptidase with thrombospondin type 1 motif, 20
  Uniprot ID: P59510
  ENST ID: ENST00000389420
  CDS Start-End: 1-5733
atgtgggtggccaagtggctgactgggctgctctaccatctctcgctcttcatcaccaggtcttgggaagttgacttccaccccaggcaagaagccctggtgaggacactgacctcctacgaagtagtgatccccgagcgggtcaatgagtttggagaagtgttccctcagagccaccacttcagccggcagaaacgcagctccgaggcgctggaacccatgccgttccgaacccactatcgcttcactgcctacgggcagctcttccagctgaacctgaccgccgatgcatcctttctggccgccggctacaccgaggtgcacttgggaaccccggagcgcggggcctgggagagcgacgcagggccctcggacctgcgccactgcttctaccgcggccaggtcaactcacaggaggattacaaggccgtcgtcagcttatgcggaggcctgacgggaacatttaaaggacagaacggtgaatatttcttagaacctataatgaaggcagatgggaatgaatatgaagatggtcacaacaagccacatcttatatacagacaagacttaaataactcttttctgcagactctgaagtattgcagtgtgtcagaaagtcaaataaaggaaaccagtttaccctttcatacctacagcaacatgaatgaagatcttaatgtaatgaaagaaagagttttaggacacacatcaaaaaatgtaccattgaaagatgaaagaagacattccaggaaaaaacgtcttatatcatatccaagatacattgaaattatggttacagctgatgctaaagtggtttctgctcatggatcgaatttgcaaaactatatactgactctaatgtcaattgttgcaacaatctacaaagatccaagtattggaaatttgatacacatagtagtggtaaaattagttatgattcaccgtgaggaggaaggaccagtcattaattttgatggtgctaccacattaaagaacttttgttcatggcaacaaactcagaatgaccttgatgatgttcacccttcccaccatgacactgctgttcttatcactagggaagacatttgttcatctaaagagaaatgtaacatgttaggtttatcatatttaggtaccatatgtgatcctttacaaagctgctttattaatgaagaaaaaggactcatttctgcttttactatagcccatgagcttgggcacacacttggtgttcaacatgatgataatcctagatgtaaagaaatgaaagttacaaagtatcatgtaatggcccctgctttaagttttcacatgagtccttggagctggtcaaactgtagtcggaaatatgttactgaattcctagatactggttacggggaatgtcttcttgacaaaccagatgaagaaatatataatctgccttcagaacttcctggatcacgatatgatggaaacaagcagtgtgagcttgcgtttggtcctgggtcacaaatgtgtccccatataaatatatgcatgcatctgtggtgcacaagcacagaaaagcttcacaaaggctgtttcactcaacacgtgccaccagcagatggaacagactgcggtcctggaatgcattgccgtcatgggctatgtgtaaacaaagaaacggaaacacgtcctgtaaatggtgaatggggaccatgggaaccttacagttcttgttcaagaacatgtggaggcggaatcgaaagtgcaaccaggcgctgtaatcgtcctgagccaagaaacggaggaaattactgtgtgggccgcaggatgaaatttcgatcatgtaatactgattcatgtccaaaaggcacacaagactttcgagagaagcagtgctctgattttaatggtaaacatttggacatcagtggcattccctctaatgtgaggtggcttccaagatacagtggcattggcacaaaggatcgttgtaaactctattgtcaggttgctggaaccaattatttctacctattgaaggatatggttgaagatggtactccttgtggaactgaaactcatgacatctgtgttcaaggccagtgtatggcagctggttgtgatcacgtgttaaactccagtgccaagatagacaaatgtggagtgtgtggtggggacaactcttcatgcaagacaataacaggtgtcttcaacagttctcattatggttataatgttgttgtaaagattcccgcaggagcaacaaacgttgacattcgtcagtacagctattctggacaaccagatgacagttaccttgcattatctgacgctgaagggaattttcttttcaatggaaattttcttctaagtacgtcaaaaaaagaaatcaatgtgcaaggaacaagaactgttattgaatacagtggatcaaataacgcagttgaaagaattaatagtactaatcgacaagagaaagaacttattttgcaggtgttgtgtgtgggtaatttatacaaccctgatgtacattattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagagctgtgtacttacaccttgctcatttatttctaaacttgagaccgctttattaccaactgttctcataaaaaagatggcacaatggcgacatggttcttggaccccatgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcgtgctcagcttcttgtggtaaaggtagaaagtaccgtgaagtgttttgcattgaccaattccaaaggaaattagaagacacaaattgcagtcaagtacagaaacctccaactcacaaagcctgtagatctgtcagatgcccttcatggaaagccaatagctggaatgagtgctctgtgacctgtggctctggagttcagcagagggatgtatactgcagactgaaaggtgttggtcaggtggttgaagaaatgtgtgatcagtccacccgaccttgttctcagaggcgatgttggagtcaggactgtgtgcagcacaaggggatggaaagagggaggctgaattgttcaacatcatgtgagagaaaagattcacatcaacgaatggagtgcacagataaccaaatcagacaagtgaatgaaatagtctataattcttcaaccatatctcttacatccaagaattgcaggaaccctccttgcaattacattgtggtaacagcagactcatcacagtgtgcaaacaactgtggatttagttacagacaaaggattacatattgcaccgagatcccatctactaagaaacataagctccatcgacttcggcctatagtttatcaagaatgccctgtggtgccttcctctcaggtttaccaatgcattaacagctgtttgcatttggccacttggaaagttggaaaatggagcaagtgctcagtgacttgtggaattgggataatgaagagacaagtgaaatgcattaccaaacatggtttgtccagtgacttatgtttaaaccatttaaaaccaggtgctcaaaagaaatgttatgccaatgactgtaaatcatttaccacctgcaaagaaattcaagtgaaaaaccacattagaaaggatggtgactattaccttaacattaagggaagaataataaagatttattgtgcagacatgtacttggagaaccctaaggaatatttaacactggtccaaggtgaagaaaacttttctgaagtgtatggctttagactaaaaaatccatatcaatgtccttttaatgggagtagaagggaagactgtgaatgtgacaatggacacttagctgctggatacactgttttcagcaaaataagaattgatctcacttccatgcaaattaaaactacggaccttcttttttccaaaacaatatttggaaatgcagttccatttgccacagctggagattgctacagtgctttcagatgcccacagggacagtttagcattaatttgtcaggaactgggatgaagatatccagcacagcaaagtggctcactcaggggagttatacctctgtcagcatacgaagatcagaggatggaactagatttttcggcaaatgtggagggtactgtggaaagtgtcttcctcacatgactactggtctcccaattcaagtcatatgaacatttagaagggggaagtatgccctaaagaggggatattctctggaatattcaaataactggtgctcatttctttatatctcccttcccgagatttccatgtccaatatgtctctgcctttttttcagggtgctcatcagggattcaaatcactgcttaataaggtctataaaagaaatttaagagctatcttaatttattttatatctaatcaggatattttttaaagaacataataatttataatagagaataccaggattgaatgaattataccaagacagtgttgctcttaacatcttggcctggaccacacttattttatacctataaacacacatg

SEQ ID NO: 104749 - DNA, 4633 bp, Homo sapiens
  Payload ID: 568
  Gene Symbol: ADAMTS20
  Gene Name: ADAM metallopeptidase with thrombospondin type 1 motif, 20
  ENST ID: ENST00000395541
  CDS Start-End: 1-4515
atgtgggtggccaagtggctgactgggctgctctaccatctctcgctcttcatcaccaggtcttgggaagttgacttccaccccaggcaagaagccctggtgaggacactgacctcctacgaagtagtgatccccgagcgggtcaatgagtttggagaagtgttccctcagagccaccacttcagccggcagaaacgcagctccgaggcgctggaacccatgccgttccgaacccactatcgcttcactgcctacgggcagctcttccagctgaacctgaccgccgatgcatcctttctggccgccggctacaccgaggtgcacttgggaaccccggagcgcggggcctgggagagcgacgcagggccctcggacctgcgccactgcttctaccgcggccaggtcaactcacaggaggattacaaggccgtcgtcagcttatgcggaggcctggtgggaacatttaaaggacagaacggtgaatatttcttagaacctataatgaaggcagatgggaatgaatatgaagatggtcacaacaagccacatcttatatacagacaagacttaaataactcttttctgcagactctgaagtattgcagtgtgtcagaaagtcaaataaaggaaaccagtttaccctttcatacctacagcaacatgaatgaagatcttaatgtaatgaaagaaagagttttaggacacacatcaaaaaatgtaccattgaaagatgaaagaagacattccaggaaaaaacgtcttatatcatatccaagatacattgaaattatggttacagctgatgctaaagtggtttctgctcatggatcgaatttgcaaaactatatactgactctaatgtcaattgttgcaacaatctacaaagatccaagtattggaaatttgatacacatagtagtggtaaaattagttatgattcaccgtgaggaggaaggaccagtcattaattttgatggtgctaccacattaaagaacttttgttcatggcaacaaactcagaatgaccttgatgatgttcacccttcccaccatgacactgctgttcttatcactaggtatgacatttgttcatctaaagagaaatgtaacatgttaggtttatcatatttaggtaccatatgtgatcctttacaaagctgctttattaatgaagaaaaaggactcatttctgcttttactatagcccatgagcttgggcacacacttggtgttcaacatgatgataatcctagatgtaaagaaatgaaagttacaaagtatcatgtaatggcccctgctttaagttttcacatgagtccttggagctggtcaaactgtagtcggaaatatgttactgaattcctagatactggttacggggaatgtcttcttgacaaaccagatgaagaaatatataatctgccttcagaacttcctggatcacgatatgatggaaacaagcagtgtgagcttgcgtttggtcctgggtcacaaatgtgtccccatataaatatatgcatgcatctgtggtgcacaagcacagaaaagcttcacaaaggctgtttcactcaacacgtgccaccagcagatggaacagactgcggtcctggaatgcattgccgtcatgggctatgtgtaaacaaagaaacggaaacacgtcctgtaaatggtgaatggggaccatgggaaccttacagttcttgttcaagaacatgtggaggcggaatcgaaagtgcaaccaggcgctgtaatcgtcctgagccaagaaacggaggaaattactgtgtgggccgcaggatgaaatttcgatcatgtaatactgattcatgtccaaaaggcacacaagactttcgagagaagcagtgctctgattttaatggtaaacatttggacatcagtggcattccctctaatgtgaggtggcttccaagatacagtggcattggcacaaaggatcgttgtaaactctattgtcaggttgctggaaccaattatttctacctattgaaggatatggttgaagatggtactccttgtggaactcattcttataatattgattgtaattgtgtcttgaaggcagctggttgtgatcacgtgttaaactccagtgccaagatagacaaatgtggagtgtgtggtggggacaactcttcatgcaagacaataacaggtgtcttcaacagttctcattatggttataatgttgttgtaaagattcccgcaggagcaacaaacgttgacattcgtcagtacagctattctggacaaccagatgacagttaccttgcattatctgacgctgaagggaattttcttttcaatggaaattttcttctaagtacgtcaaaaaaagaaatcaatgtgcaaggaacaagaactgttattgaatacagtggatcaaataacgcagttgaaagaattaatagtactaatcgacaagagaaagaaattcttattgaggtgttgtgtgtgggtaatttatacaaccctgatgtacattattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagagctgtgtacttacaccttgctcatttatttctaaacttgagaccgctttattaccaactgttctcataaaaaagatggcacaatggcgacatggttcttggaccccatgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggtcagtgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactg

SEQ ID NO: 104750 - DNA, 2780 bp, Homo sapiens
  Payload ID: 568
  Gene Symbol: ADAMTS20
  Gene Name: ADAM metallopeptidase with thrombospondin type 1 motif, 20
  ENST ID: ENST00000549670
  CDS Start-End: 1-1905
tattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagtgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactgtggattactttcttggaattttttcccaattaggagagcagaatcctaactgctaatgagattgaattgtaatggcatttgtttctgagcatagacgttttattttccctacccattcatgacttcaattcaccaagcattaaacatttacttaggtctcatgctttatattagatattgaagcaattaaaattaagtgtttgtgagtcagattctctgttttagaggtcagcaaactatggtccaggtaccaaatctggcctgttgcctatttttaaaataagttctattggaacacagtcatgctcatttgtttacgtgttatctatggctggttttgcactacagcagtagcattgattagttgcaatagaaactctgtaactcacaaagcctgaaatatttactatctaactttttctgggaaaagtttgctgacccctgttctatttaataaacattataatgcttttaagtttaacataaaaaggtacttagatttatagaatattaaaattacaaataattcattccaggtcagttttagatgtttttgatcctttgatattttacattttaaggtttatcaaccttctctacatatccactgtgatattcatgcaatgtttatgtaaatgtatctatactatattccaatatatttttgttatgctattttttgtatgtaaattatatcacaagtgaaaaatctgaatgctcattaaagtcctctgtatagatgacttttcaacctcac

SEQ ID NO: 104751 - DNA, 4633 bp, Homo sapiens
  Payload ID: 568
  Gene Symbol: ADAMTS20
  Gene Name: ADAM metallopeptidase with thrombospondin type 1 motif, 20
  ENST ID: ENST00000553158
  CDS Start-End: 1-4515
atgtgggtggccaagtggctgactgggctgctctaccatctctcgctcttcatcaccaggtcttgggaagttgacttccaccccaggcaagaagccctggtgaggacactgacctcctacgaagtagtgatccccgagcgggtcaatgagtttggagaagtgttccctcagagccaccacttcagccggcagaaacgcagctccgaggcgctggaacccatgccgttccgaacccactatcgcttcactgcctacgggcagctcttccagctgaacctgaccgccgatgcatcctttctggccgccggctacaccgaggtgcacttgggaaccccggagcgcggggcctgggagagcgacgcagggccctcggacctgcgccactgcttctaccgcggccaggtcaactcacaggaggattacaaggccgtcgtcagcttatgcggaggcctgacgggaacatttaaaggacagaacggtgaatatttcttagaacctataatgaaggcagatgggaatgaatatgaagatggtcacaacaagccacatcttatatacagacaagacttaaataactcttttctgcagactctgaagtattgcagtgtgtcagaaagtcaaataaaggaaaccagtttaccctttcatacctacagcaacatgaatgaagatcttaatgtaatgaaagaaagagttttaggacacacatcaaaaaatgtaccattgaaagatgaaagaagacattccaggaaaaaacgtcttatatcatatccaagatacattgaaattatggttacagctgatgctaaagtggtttctgctcatggatcgaatttgcaaaactatatactgactctaatgtcaattgttgcaacaatctacaaagatccaagtattggaaatttgatacacatagtagtggtaaaattagttatgattcaccgtgaggaggaaggaccagtcattaattttgatggtgctaccacattaaagaacttttgttcatggcaacaaactcagaatgaccttgatgatgttcacccttcccaccatgacactgctgttcttatcactagggaagacatttgttcatctaaagagaaatgtaacatgttaggtttatcatatttaggtaccatatgtgatcctttacaaagctgctttattaatgaagaaaaaggactcatttctgcttttactatagcccatgagcttgggcacacacttggtgttcaacatgatgataatcctagatgtaaagaaatgaaagttacaaagtatcatgtaatggcccctgctttaagttttcacatgagtccttggagctggtcaaactgtagtcggaaatatgttactgaattcctagatactggttacggggaatgtcttcttgacaaaccagatgaagaaatatataatctgccttcagaacttcctggatcacgatatgatggaaacaagcagtgtgagcttgcgtttggtcctgggtcacaaatgtgtccccatataaatatatgcatgcatctgtggtgcacaagcacagaaaagcttcacaaaggctgtttcactcaacacgtgccaccagcagatggaacagactgcggtcctggaatgcattgccgtcatgggctatgtgtaaacaaagaaacggaaacacgtcctgtaaatggtgaatggggaccatgggaaccttacagttcttgttcaagaacatgtggaggcggaatcgaaagtgcaaccaggcgctgtaatcgtcctgagccaagaaacggaggaaattactgtgtgggccgcaggatgaaatttcgatcatgtaatactgattcatgtccaaaaggcacacaagactttcgagagaagcagtgctctgattttaatggtaaacatttggacatcagtggcattccctctaatgtgaggtggcttccaagatacagtggcattggcacaaaggatcgttgtaaactctattgtcaggttgctggaaccaattatttctacctattgaaggatatggttgaagatggtactccttgtggaactgaaactcatgacatctgtgttcaaggccagtgtatggcagctggttgtgatcacgtgttaaactccagtgccaagatagacaaatgtggagtgtgtggtggggacaactcttcatgcaagacaataacaggtgtcttcaacagttctcattatggttataatgttgttgtaaagattcccgcaggagcaacaaacgttgacattcgtcagtacagctattctggacaaccagatgacagttaccttgcattatctgacgctgaagggaattttcttttcaatggaaattttcttctaagtacgtcaaaaaaagaaatcaatgtgcaaggaacaagaactgttattgaatacagtggatcaaataacgcagttgaaagaattaatagtactaatcgacaagagaaagaacttattttgcaggtgttgtgtgtgggtaatttatacaaccctgatgtacattattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcatgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagagctgtgtacttacaccttgctcatttatttctaaacttgagaccgctttattaccaactgttctcataaaaaagatggcacaatggcgacatggttcttggaccccatgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccatcagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactg

SEQ ID NO: 104752 - DNA, 5822 bp, Homo sapiens
  Payload ID: 569
  Gene Symbol: ADAMTS3
  Gene Name: ADAM metallopeptidase with thrombospondin type 1 motif, 3
  Uniprot ID: O15072
  ENST ID: ENST00000286657
  CDS Start-End: 38-3655
gctttgcccagtagttggaaagtgaactcgactcgtgatggttctcctgtcactttggttgatagcagccgctctggtagaggttaggacttcagctgatggacaagctggtaatgaagaaatggtgcaaatagatttaccaataaagagatatagagagtatgagctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggagaacagagcctttgcagactaactgtgcttatgttggtgacatcgtggacattccaggaacctctgttgccatcagcaactgtgatggtctggctggaatgataaaaagtgataatgaagagtatttcattgaacccttggaaagaggtaaacagatggaggaagaaaaaggaaggattcatgttgtctacaagagatcagctgtagaacaggctcccatagacatgtccaaagacttccactacagagagtcggacctggaaggccttgatgatctaggtactgtttatggcaacatccaccagcagctgaatgaaacaatgagacgccgcagacacgcgggagaaaacgattacaatatcgaggtactgctgggagtggatgactctgtggtccgtttccatggcaaagagcacgtccaaaactacctcctgaccctaatgaacattgtgaatgaaatttaccatgatgagtccctcggagtgcatataaatgtggtcctggtgcgcatgataatgctgggatatgcaaagtccatcagcctcatagaaaggggaaacccatccagaagcttggagaatgtgtgtcgctgggcgtcccaacagcaaagatctgatctcaaccactctgaacaccatgaccatgcaatttttttaaccaggcaagactttggacctgctggaatgcaaggatatgctccagtcaccggcatgtgtcatccagtgagaagttgtaccctgaatcatgaggatggtttttcatctgcttttgtagtagcccatgaaacgggccatgtgttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgttccgaacctttgacccatgtaaacagctgtggtgtagccatcctgataatccctacttttgtaagactaaaaagggacctccacttgatgggactgaatgtgctgctggaaaatggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgttttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgaatcaacaatgtgatacgtaaattatagaaaaagaaaagaaacacaaaagctatagatatacagatatcagcttacctattgccttctatacttataatttaaaggattggtgtcttagtacacttgtggtcacagggatcaacgaatagtaaataatgaactcgtgcaagacaaaactgaaaccctctttccaggacctcagtaggcaccgttgaggtgtcctttgtttttgtgtgtgtgtgttcttttttaattttcgcattgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcaggttcaagaaagcatatgtcgatggttgagatatttattttccatatggttcatgttcaaatgttcacaaccacaatgcatctgactgcaataatgtgctaataatttatgtcagtagtcaccttgctcacagcaaagccagaaatgctctctccagggagtagatgtaaagtacttgtacatagaattcagaactgaagatatttattaaaagttgattttttttcttgatagtatttttatgtactaaatatttacactaatatcaattacatattttggtaaactagagagacataattagagatgcatgctttgttctgtgcatagagacctttaagcaaactactacagccaactcaaaagctaaaactgaacaaatttgatgttatgcaaacatcttgcatttttagtagttgatattaagttgatgacttgtttcccttcaaggaaacattaaattgtatggactcagctagctgttcaatgaaattgtgaattagaaacatttttaaaagtttttgaaagagataagtgcatcatgaattacatgtacatgagaggagatagtgatatcagcataatgattttgaggtcagtacctgagctgtctaaaaatatattatacaaactaaaatgtagatgaattaacctctcaaagcacagaatgtgcaagaacttttgcattttaatcgttgtaaactaacagcttaaactattgactctatacctctaaagaattgctgctactttgtgcaagaactttgaaggtcaaattaggcaaattccagatagtaaaacaatccctaagccttaagtcttttttttttcctaaaaattcccatagaataaaattctctctagtttacttgtgtgtgcatacatctcatccacaggggaagataaagatggtcacacaaacagtttccataaagatgtacatattcattatacttctgacctttgggctttcttttctactaagctaaaaattcctttttatcaaagtgtacactactgatgctgtttgttgtactgagagcacgtaccaataaaaatgttaacaaaatata

SEQ ID NO: 104753 - DNA, 4479 bp, Homo sapiens
  Payload ID: 569
  Gene Symbol: ADAMTS3
  Gene Name: ADAM metallopeptidase with thrombospondin type 1 motif, 3
  Uniprot ID: O15072
  ENST ID: ENST00000622135
  CDS Start-End: 35-3652
ttgcccagtagttggaaagtgaactcgactcgtgatggttctcctgtcactttggttgatagcagccgctctggtagaggttaggacttcagctgatggacaagctggtaatgaagaaatggtgcaaatagatttaccaataaagagatatagagagtatgagctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggagaacagagcctttgcagactaactgtgcttatgttggtgacatcgtggacattccaggaacctctgttgccatcagcaactgtgatggtctggctggaatgataaaaagtgataatgaagagtatttcattgaacccttggaaagaggtaaacagatggaggaagaaaaaggaaggattcatgttgtctacaagagatcagctgtagaacaggctcccatagacatgtccaaagacttccactacagagagtcggacctggaaggccttgatgatctaggtactgtttatggcaacatccaccagcagctgaatgaaacaatgagacgccgcagacacgcgggagaaaacgattacaatatcgaggtactgctgggagtggatgactctgtggtccgtttccatggcaaagagcacgtccaaaactacctcctgaccctaatgaacattgtgaatgaaatttaccatgatgagtccctcggagtgcatataaatgtggtcctggtgcgcatgataatgctgggatatgcaaagtccatcagcctcatagaaaggggaaacccatccagaagcttggagaatgtgtgtcgctgggcgtcccaacagcaaagatctgatctcaaccactctgaacaccatgaccatgcaatttttttaaccaggcaagactttggacctgctggaatgcaaggatatgctccagtcaccggcatgtgtcatccagtgagaagttgtaccctgaatcatgaggatggtttttcatctgcttttgtagtagcccatgaaacgggccatgtgttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgttccgaacctttgacccatgtaaacagctgtggtgtagccatcctgataatccctacttttgtaagactaaaaagggacctccacttgatgggactgaatgtgctgctggaaaatggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgttttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcag

SEQ ID NO: 104754 - DNA, 1961 bp, Homo sapiens
  Payload ID: 570
  Gene Symbol: ADAMTS4
  Gene Name: ADAM metallopeptidase with thrombospondin type 1 motif, 4
  ENST ID: ENST00000367995
  CDS Start-End: 427-1446
ggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggtgaggccccagtcagcaccgcaggccatgcactgcacaattctaagaagcgccactacatagactatgatgcaaatgatgttcctggagttgtgtgacatggtgccttgccccagccacactgccatgtgtggctacctaggccctgacagtgctgggtcctcagtgcccaggtccccgggaatctggatctcaacccaatggacccaggtgtcttggctgtctatgcaccttctatgatccctctccacaggacctgtgtggagtctccacttgcgacacgctgggtatggctgatgtgggcaccgtctgtgacccggctcggagctgtgccattgtggaggatgatgggctccagtcagccttcactgctgctcatgaactgggtaaagtaggggtggatgagaaaggtattagggaggagaaggtgggggagggggtagcaagttcaccacagtgttaatgggggtcccaaggtattcttcccccaggcctaggtatagggctattactcctctctgctccaggtgtagacatacatttacatttttctattaaataaattagttggtcgaaac

SEQ ID NO: 104755 - DNA, 9773 bp, Homo sapiens
  Payload ID: 570
  Gene Symbol: ADAMTS4
  Gene Name: ADAM metallopeptidase with thrombospondin type 1 motif, 4
  Uniprot ID: O75173
  ENST ID: ENST00000367996
  CDS Start-End: 430-2943
tggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccaggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccggctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcagcatctagtaagtgctcaacaaatagcagctgctgttacttactgttatcaaatttctgtccacatccactctccatatgcacttgaaggtggcaaagatccacaaccatggtgcctgcctttatcctcagggtccgttcctttggttggcagacccctatcctgggttctgagggaccaacagagaaaggaaaattccatccctcacctctggaagttcccaatcacaggaaggaaacatagtaagcacgtggctacaaatacaattgacaagaacatgaaggtgcaggataacaagaacaaataacaagaacaactgcatcaacacaaatgagtgcttagtaataagggtgatagttgaggggtctgggtttcacaacagtagaaagagcactggagtgggagccagcgggtctggattcaatttggggctcggcgtcttattagctgggtggtgttgggtaagtcactgatgctgagccttagattgctcatatgggactaacagtatctactcccacagagttgttctgggaacaaatgctagaatattttcaaaatagtaaaggttatagtcatggccatgtgagaggttacccctatgactacctgaagatggaacggagtctccagaatctgccagtgtaaacccagcagaatgcctagaagatgtgagattagaataaaatttcataaaacaaaaacaatcgggcacggtggctcatgcctgtaatcccagcactttgggaggccgaaatgggcggatcacgaggtcaggagattgagaccgaccatcctggctaccacagtgaaaccccgtgtctactaaaaatacaaaatatatatatatatatatatatatattagccgggcatggtgacaggtgcctatagtcccagctacttgggagactgaggcaggagaatgacttgcacccgggaggcagagcttacagtgagtcgagattgcgccactgcactccagcctgggagacagagtgagactcgtctcgatacaaaaacaaaaacaaaaacaggatatggtttggcaggaaataggcaagaaggcaaaaagaataacctggaaaaggatctgaggtaagggagccaggtgcctcaaaatggcagaatacctgatgcctgaggagagggagggaataaaacatctgcattttcccctctgggcaaggcgcctttgcttgagaaagaattttgggctggatgagatggttcacacctgtaatcccagtactttggcaggaggattgcttgaggccaggaggttgggaccaacctgggcaacatagaaagattccatctctaccaaaaaaaaaaaagattgaaaaattagccgggcgtggtggcacctgtagtcccagctacttgggaggctaaaataggaggactgcttgagcccacgatttcgaggctatggtgagctacaatcatgccactatactccagcctgggtgagagaccaaaacaccaactcaaaaaaaaaaaaaaaaaaaaaaaaagggccaggcatggtggctcacacctgtaatctcagcactttgggaggctgaggttcaaaaccagccaggccaacatggtgaaaccccatctctactaaaaaaaaaatacaaaaaattagccaggtgtggtggcaagcgcctatagtcccagctactcatgaggctgaggcaggaggatcgcttgaacctgggaggtggaggttgcagtgagccgaaattgcgccattgcactccagtctgggcgatagagtgagactccatctcaaaaaaaaaaaaaaaaaaaaaaagaacttgggcagtcctctatgtgtcatggatggaacagggatgggcaagggtggtaggtagaccctgcaagaatttggagttttgagaggcagacgcaggactgctagggattggggaaggtactggatgtggggttgtgggagaaactataggtaaagaagaccctgaggttgaggtggaagagtgaagaatgggggaaccaaaggcacttcactctgccatagcagcccctagctgggatgccaaatactgcttggaatgtgaagctgggactatggggttgaggcaggccatggaggttgtagtggttatatgtgctatgcttactggatctgggctttgctaatcaagttctgtaccaggcagtgccttatacagcaccctgtactctacaccagccagcacagcgcctgcttcctctgcagcaatgagaaaagactgcccacactctcttctctccagtaaacacggttctccctgctaggcttggccccctggcccttcctgtggtcctcctactaaccaggctgaagaagatggagacaagacaatagtgatctttactcgtttcatctagtttgcaaaatgagaccacagatagtatgtttatggaccttgatactatgagttgatggtacaatgagcagagttctgtgataagtagatgtaaggtacaaatacaaacaatatatacgactgtcctaaaggggttcacactgcattctgggcaggggaggttgtatactgctcccactccaccttccccgcaaacagaagcaatgggacagtaaaagggactagaagataagagcctaatgagccctgaactgaatggactatgagggttatggagggctaccttgggctgggccctggagaacaggtcatcatgatagcccttctcactttcctttaatgttcatggagatacacttttttttttgagatagggtctccctttgttgaccaggcaggagtacagtggtgtgatcttggctcactgcagccttgaactctcaggctcaagcaaccctcccacctcaacctcctgagtacctaggactacaggcacgagctaccacacccagctaatttacttttttttttggttgagacgaggtcttatcatattgcccaggctggtcttgaactcctggcctcaagggatcttcccacctcgatctcccaaagtgttgggatgaccagtgtgaaccaccatgcctggccttttcttttgagacagtctcgctctgtggctcaggttggagtgcagtggcaccatcataacttactacagccttgaactcctgggctcgagtaatcctcccacctcagcctcctaagtagcttggactacaggtgtagattcacttttaaatcacttttctgcctgttattttaagagaaagcccttcgctcaccaagtagggttctcactggcataagtaagtttttctgaaaatgagactgagcttaggggccacctctgtgattgggtaagtaagcaggagctagagtgaaagaggggcagagagagctagctcatcgaagagaagtgatgggcatctcagccctcaatcccaggcaaggcctgacccttttctggaatggtctctgccttaccacacctccaagacccagattgtaggtaggctttacctaataggagtccaacaagttcttgctagggatgggattgtgggggggcacatatctccctgtaagagccacagtgagctctgtttcccatctgcctacttattgccctcgtgggcctgagctggggtgtagatatataaggaggaacagaaacagtaataacaggaagtaaggaggcactgaaacaattcaagtatctggtcctggagatgaaaagaggaaatggaaaaagaaaaggcattgaatgacaagggattagaaccctgtccctagagaagttcaagaagagtttggacaaccattttatgagatggcaagtgttgtgcatgagtatgtgtttgaggtgggggaggaagttgaagcaataagttgggccaatttcctaaagtcccttctgcccctgagattctctgcttctgtggttcaaacagaggaaatctggacatttgtccagccactatttttgtaatggaggtgggacagccagggttcctggagtgtgctgtggaatcggcatttacacttctcttccatctctagtctcatttctgtaatcttcatacagtattacagtattttgttttctaaaataccagattggcagtaagtgacaaaactagcatctcattggtcagggcttgtgggggaggaagggagaagaaagtggatttcaatgtattaacattttattggctgagaggatgtttctgaaccaattgagtaccttccccattgactgttgctggggccaagccaaaatcattggcaccacgagaaaccagatgacagctggaggaaaccacgagtgctaaaaatgctcagaaagaggggggtcagggaaggcgggggagcaacaacactgaacaacttccccaggcaggatcttacatggggacagacccagggtacttaagtagcattaggaaggaaagggaggggaggaagtagattaagtatccctcacagtcttggcacaacaaacaggcaccatacacccacaccaacagtgacacattgacataacacacatccaacttcacagagacacactagcacattctctcttttttttaaaatttattttattattattatactttaagttttagggtacatgtgcacaatgtgcaggttagttacatatgtatacatgtgccatgctggtgtgctgcacccattaactcatcatttagcattaggtatatctcctaatgctatccctcccccctccccccctgcctttctttttcttcttttttttcttaagacagattctcattctgtcacccaggctagagtgcaatggcgtgatctcggctcactgcaacctccacctcccaggttcaagtgattctcctgcctcagcctgccaagtagctgggattacaggtatgcaccaccatgcccagctaattttttgtatttttagtatagagacggggttttccatgttgcccaggctggtcttgaactcccgggctcaagtgatctgcctgcctcggcctcccaaagtgctgggattacaggtgtgagccagggtgcctggccaacacattctgttgataatatagatgcaaataagtagtagggagcggaaaatgtaagaattttcacctgaaaatggatctgaagagtaaaagatattaattgacctaatcgtgcattgagaattgactgtttatcccatttatttgttcaataaataagccaatgggttgtaaacattgtaaacattccacagcatgtggaaaggacatggatttttggagtcaaattgaatctaagccttgctacttacttacctgtaatgatgcaaccttaattacttgatctctgtaaacctcagtttccttacctacaaaacgtttgtactattacctgccttatagagaggtccagacttaagaatatgatgatgtaaatgtttggcactgtgtctggcttttagtaagtggtcaataaaggccagttctcctt

SEQ ID NO: 104756 - DNA, 9056 bp, Homo sapiens
  Payload ID: 571
  Gene Symbol: ADAMTS5
  Gene Name: ADAM metallopeptidase with thrombospondin type 1 motif, 5
  Uniprot ID: Q9UNA0
  ENST ID: ENST00000284987
  CDS Start-End: 123-2915
cttgactcaatcctgcaagcaagtgtgtgtgtgtccccatcccccgccccgttaacttcatagcaaataacaaatacccataaagtcccagtcgcgcagcccctccccgcgggcagcgcactatgctgctcgggtgggcgtccctgctgctgtgcgcgttccgcctgcccctggccgcggtcggccccgccgcgacacctgcccaggataaagccgggcagcctccgactgctgcagcagccgcccagccccgccggcggcagggggaggaggtgcaggagcgagccgagcctcccggccacccgcaccccctggcgcagcggcgcaggagcaaggggctggtgcagaacatcgaccaactctactccggcggcggcaaggtgggctacctcgtctacgcgggcggccggaggttcctcttggacctggagcgagatggttcggtgggcattgctggcttcgtgcccgcaggaggcgggacgagtgcgccctggcgccaccggagccactgcttctatcggggcacagtggacggtagtccccgctctctggctgtctttgacctctgtgggggtctcgacggcttcttcgcggtcaagcacgcgcgctacaccctaaagccactgctgcgcggaccctgggcggaggaagaaaaggggcgcgtgtacggggatgggtccgcacggatcctgcacgtctacacccgcgagggcttcagcttcgaggccctgccgccgcgcgccagctgcgaaacccccgcgtccacaccggaggcccacgagcatgctccggcgcacagcaacccgagcggacgcgcagcactggcctcgcagctcttggaccagtccgctctctcgcccgctgggggctcaggaccgcagacgtggtggcggcggcggcgccgctccatctcccgggcccgccaggtggagctgcttctggtggctgacgcgtccatggcgcggttgtatggccggggcctgcagcattacctgctgaccctggcctccatcgccaataggctgtacagccatgctagcatcgagaaccacatccgcctggccgtggtgaaggtggtggtgctaggcgacaaggacaagagcctggaagtgagcaagaacgctgccaccacactcaagaacttttgcaagtggcagcaccaacacaaccagctgggagatgaccatgaggagcactacgatgcagctatcctgtttactcgggaggatttatgtgggcatcattcatgtgacaccctgggaatggcagacgttgggaccatatgttctccagagcgcagctgtgctgtgattgaagacgatggcctccacgcagccttcactgtggctcacgaaatcggacatttacttggcctctcccatgacgattccaaattctgtgaagagacctttggttccacagaagataagcgcttaatgtcttccatccttaccagcattgatgcatctaagccctggtccaaatgcacttcagccaccatcacagaattcctggatgatggccatggtaactgtttgctggacctaccacgaaagcagatcctgggccccgaagaactcccaggacagacctacgatgccacccagcagtgcaacctgacattcgggcctgagtactccgtgtgtcccggcatggatgtctgtgctcgcctgtggtgtgctgtggtacgccagggccagatggtctgtctgaccaagaagctgcctgcggtggaagggacgccttgtggaaaggggagaatctgcctgcagggcaaatgtgtggacaaaaccaagaaaaaatattattcaacgtcaagccatggcaactggggatcttggggatcctggggccagtgttctcgctcatgtggaggaggagtgcagtttgcctatcgtcactgtaataaccctgctcccagaaacaacggacgctactgcacagggaagagggccatctaccgctcctgcagtctcatgccctgcccacccaatggtaaatcatttcgtcatgaacagtgtgaggccaaaaatggctatcagtctgatgcaaaaggagtcaaaacttttgtggaatgggttcccaaatatgcaggtgtcctgccagcggatgtgtgcaagctgacctgcagagccaagggcactggctactatgtggtattttctccaaaggtgaccgatggcactgaatgtaggctgtacagtaattccgtctgcgtccgggggaagtgtgtgagaactggctgtgacggcatcattggctcaaagctgcagtatgacaagtgcggagtatgtggaggagacaactccagctgtacaaagattgttggaacctttaataagaaaagtaagggttacactgacgtggtgaggattcctgaaggggcaacccacataaaagttcgacagttcaaagccaaagaccagactagattcactgcctatttagccctgaaaaagaaaaacggtgagtaccttatcaatggaaagtacatgatctccacttcagagactatcattgacatcaatggaacagtcatgaactatagcggttggagccacagggatgacttcctgcatggcatgggctactctgccacgaaggaaattctaatagtgcagattcttgcaacagaccccactaaaccattagatgtccgttatagcttttttgttcccaagaagtccactccaaaagtaaactctgtcactagtcatggcagcaataaagtgggatcacacacttcgcagccgcagtgggtcacgggcccatggctcgcctgctctaggacctgtgacacaggttggcacaccagaacggtgcagtgccaggatggaaaccggaagttagcaaaaggatgtcctctctcccaaaggccttctgcgtttaagcaatgcttgttgaagaaatgttagcctgtggttatgatcttatgcacaaagataactggaggattcagcactgatgcagtcgtggtgaacaggaggtctacctaacgcacagaaagtcatgcttcagtgacattgtcaacaggagtccaattatgggcagaatctgctctctgtgaccaaaagaggatgtgcactgcttcacgtgacagtggtgaccttgcaatatagaaaaacttgggagttattgaacatcccctgggcttacaagaaacactgatgaatgtaaaatcaggggacatttgaagatggcagaactgtctcccccttgtcacctacctctgatagaatgtctttaatggtatcataatcattttcacccataatacacagtagcttcttcttactgtttgtaaatacattctcccttggtatgtcactttatatcccctggttctattaaaatatccatatatatttctataaaaaaagtgtttgaccaaagtaggtctgcagctatttcaacttccttccgtttccagaaagagctgtggatattttactggaaattaagaacttgctgctgttttaataagatgtagtatattttctgactacaggagataaaatttcagtcaaaaaaccattttgacagcaagtatcttctgagaaattttgaaaagtaaatagatctcagtgtatctagtcacttaaatacatacacgggttcatttacttaaacctttgactgcctgtatttttttcaggtagctagccaaattaatgcataatttcagatgtagaagtagggtttgcgtgtgtgtgtgtgatcatactcaagagtctaaaaactagtttccttgtgttggaaatttaaaaggaaaaaaatcgtatttcactgtgttttcaatttatattttcacaactactttctctctccagagctttcatctgatatctcacaatgtatgatatacgtacaaaacacacagcaagttttctatcatgtccaacacattcaacactggtatacctcctaccagcaagcctttaaaatgcatttgtgtttgcttatttgttttgttcaagggttcagtaagacctacaatgttttgtatttcttgacttattttattagaaacattaaagatcacttggtagttagccacattgagaagtggttatcattgttaatgtggttaatgccaaaaagtggttaatattaataagactgtttccacaccataggcaataatttcttaatttaaaaaatctaagtatattcctattgtactaaatatttttcccaactggaaagcacttgattgtacccgtaagtgtttgagtgatgacatgtgatgattttcagaaagttgttgtttttgtttccatagcctgtttaagtaggttgtaagtttgaatagttagacatggaaattattttataagcacacacctaaagatatctttttagatgataaaatgtacacccccccatcaccaacctcacaacttagaaaatctaagttgtttgatttctttgggatttcttttgttgtgaaacactgcaaagccaatttttctttataaaaattcatagtaatcctgccaaatgtgcctattgttaaagatttgcatgtgaagatcttagggaaccactgtttgagttctacaagctcatgagagtttatttttattataagatgtttttaatataaaagaattatgtaactgatcactatattacatcatttcagtgggccaggaaaatagatgtcttgctgttttcagtattttcttaagaaattgcttttaaaacaaataattgttttacaaaaccaataattatcctttgaattttcatagactgactttgcttttgacgtagaaattttttttctcaataaattatcactttgagaaatgaggcctgtacaaggctgataacctatatgtgatggagatcacccaatgccaagggcagaaagcaaacctagttaaataggtgagaaaaaaaataataatcccagtgccatttgtctgtgcaaagagaattaggagagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttctttaaaaaaaaaaaaaaaaaagaattcgtctgaaaatgctcaggtttgtaagaatctaatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgttttgctgttgtcctactttttaatttatgcttcatgtttgtgtataaagtacacttttacactttgtgagtttacataatatacagcactggttgcttttgtatttttttacagaaagctttctgtgtgaagcaggtgtatatgtatatattcctcatgtattcttattctgatactatcatttttctttccaaggaaattttaatctgtcatgaccaatagtgttcattacttgtgcctatgataataggttttttacatcacattaacactattttttccaagtcacaaataagaaaaacacttattcaatgaaacaaggtgcaagttttaaatttgggtacacaaatagcctagaagcttcctacagacgctaagacacagccaataatcagatcctttcacttcatcgagaaacttggacaagtcgatattgatgtattagatgaaagttgtctacacacaacttctgagggatacaaacgataataaaaccaaatgttgtctgtttctcctttagaaacacctcctaaaattaatatcatttagtctctagtgtctgtaggattctacagatgagcacaaatagattgggtttgtataacaaatgctaatagtcataactgtttctacaaatatggggtgtccattaagagaatgtgatgttttcctactgctgttgaatcccatggggtgattataggacttgaaataggcagagtcacctctgatgacatcagcttgcctctgtgatttcacagtctgatcctggcaacaagacaaagcacccttggacacacagccaatctctggttgtgatatttccccattgattccttccttgttaacaaggtcattttaatggttcaggtgaggacagcagccagattcaaagtccagaatttgtgctgttacatagagttcacactgtcaaataacattgaatttaataatgatcaaatttttctagtagtctttggcagagtgtataatctcattggcatgattggtgaatattactaatctctttataatgaaagatgctttacaaataccttatatttgctaacatttcaaaactactaaataaatgaaatagccatgtgtacagaaatggtcatttaaagctttaatagaaccaaattcaagacaatgtatcatttagacacacagaaaaggaacttgtatgttttccctattatttttctcatttgccaacaatctatagttttaggttatcaaacagatagatcaacttaactggctagtacattgaaaaatcttcctaagaatcctttgttagcataatctatagagataatttctcaaattatatcatcatgatgcatataaactctataatgtataattgtgtttcatttatttaatgtatgagaacatattgaaatacaaaaccatgcattagccaaaaaattggaatacaggtagtgttcagatcagcaaaacattcagtctggtaaatgcctgcctggggctatgatatcattctcaatgcaggttttatggaaaaactaaaagaatatgttgttagatgatgttggttttgaaaaaaaaaagacattaacatacacattagttagcccagttaattgcattctactaatatagttgcacattagcaataattttgctgtctctggtctttattttgtggcttcaactaactggaccatgtggactgtaaaggtcaaatggaaaaaacgagcagtggcccctcatcctgtaaggtactgctacatcagagtgacctaaaagtctaacactgtgaggaaaactgtgatttgtaggaaaaaaaaaaaaaacaaataaaaaacagggcatgctttttaatttttttccactttcctttggcacacccaatgaacaattctaatttttattgaggtgctaacatctttcgtgaccgactgtcaaatgtggtatttttgagttactatttttctacatgattttacagtttgcaagaaagacctctaagctttgtgtcacggtagggcacaacttgatactcaaaatttgaaaaataagcacatccaatgattgttttgaccaacagtggtcagtgacgtaaactgcatgtgcatctgaggacatttaaggggtcattaaaatttgaggagcatcaggccggagtagcagacttttagatgagtcatatttcagcattcactaagtcctcagcattccattcaaactgtcgtgtatatttggcctgattttttttcaagctttgcaataatttatgttattggtaaacacttggtgactatatctcagccttttctttaacaactcacaatatattagaaacacgtctacctatactgagagtatatttacaatagaagaacatactgtatgtgactttgtaaagctagacttttgattaagaaatatataatctctggatgctatttttgcattatacactcaggcacaacgtaaaccttgatggctcatcttgctacaattacgagttgaaaaacactacttacgtatttgtatgacctattagtcagaggaaatcatacatatgctttgtaaatagactttgcagataactaaatagactgaagaaatatgttgcatttgatagaagcaattgcataaatatttggtttctatattagagtctgtgagtaaagtcaagtaataaacctaagtaggtataacagatttttaaaccttgaaacttgctttgatggtagagaaaatcattgaagatttacatactgtatataagatgtaaaatgtacgctgcttattaccctcaattttccagaagcaatggtatataatgcagttgaaaaaccaaaaatcttggaaaactaagacgggtcttgtttaaaatgtctctcagctttggcaaccttcaaatcttaatcaactatttaaagcattactgtgtcttgtagcctgcattccacaacagctctgttattcaggtaaaagacttgaactgagccgtttgggacctatactgtaatattttcattgaggaacaatatcctattttgtaaagcatttccctatgtgtgactttaaactgtaaaattaaacactgcttttgtgggttcagtgggcataataaatataaattgtaaactaggttaaagta

SEQ ID NO: 104757 - DNA, 7311 bp, Homo sapiens
  Payload ID: 572
  Gene Symbol: ADAMTS6
  Gene Name: ADAM metallopeptidase with thrombospondin type 1 motif, 6
  Uniprot ID: Q9UKP5
  ENST ID: ENST00000381055
  CDS Start-End: 858-4211
agtgtgctctgcctccgaggaaaagctgccaaaattttctcctgctgcaattcaagttggctgggggccggtagtgagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaaaaattaaaaaaagttagagaggagagggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagattcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatggggaagtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaatttaaattataaaacgggctttgaactataatttaaggagcaattataaatcaaaagtaatgaaagtttgtattatttttcttcattccacttaatttccttaggaataatcccctggttctgaacactgctgtgagccatatataaaactatattaaactgaacaataatgaggggcatagtttaaagcagtgcatcagttactgcagctgtgcaagtctataaactcagtgctgaaagactgtggccaacttgccattgtgcaagtaaagctgagatttccattaaaactttaagagaaaaacatttcaatttcatgcagaaaccagacctggggtatggtacagaccaaaggaccaggccctttgctgccaccacacaggatgccttagttcttatttgagtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatgata

SEQ ID NO: 104758 - DNA, 6956 bp, Homo sapiens
  Payload ID: 572
  Gene Symbol: ADAMTS6
  Gene Name: ADAM metallopeptidase with thrombospondin type 1 motif, 6
  Uniprot ID: Q9UKP5
  ENST ID: ENST00000381052
  CDS Start-End: 355-1233
gggagtacgtgagtcgtccagtgcaatctctattgtctgaaacttactttttatcagaatttgaagatgaaaacggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttgcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcggatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgtcaggttgccaaactttaccgtgattccagcctaggaaacgttgtgaatattatagtggcccgcttaattgttctcacagaagatcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactagatatgatatctgcacttataaaaataagccctgtggaacactgggcttggcctctgtggctggaatgtgtgagcctgaaaggagctgcagcattaatgaagacattggcctgggttcagcttttaccattgcacatgagattggtcacaattttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagaatttcttaaactcggtgattcaataagtggttcatgaatcgcccagaagccgtcctgattaaataataaagaacccatttccgttaaaatggacgtgttatgccagcttctgatgttttccggcgacggctttgcagttcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatgggtgtgtagagagctctggtgtctcagcaaaagcaaccgctgtgtcaccaacagtattccagcagctgaggggacactgtgtcaaactgggaatattgaaaaagggtggtgttatcagggagattgtgttccttttggcacttggccccagagcatagatgggggctggggtccctggtcactatggggagagtgcagcaggacctgcgggggaggcgtctcctcatccctaagacactgtgacagtccagcgtaagtagctaaaaccttcaggaggtggaaaatattgccttggggaaaggaaacggtatcgctcctgtaacacagatccatgccctttgggttcccgagattttcgagagaaacagtgtgcagactttgacaatatgcctttccgaggaaagtattataactggaaaccctatactggaggtggggtaaaaccttgtgcattaaactgcttggctgaaggttataatttctacactgaacgtgctcctgcggtgatcgatgggacccagtgcaatgcggattcactggatatctgcatcaatggagaatgcaagcacgtaggctgtgataatattttgggatctgatgctagggaagatagatgtcgagtctgtggaggggacggaagcacatgtgatgccattgaagggttcttcaatgattcactgcccaggggaggctacatggaagtggtgcagataccaagaggctctgttcacattgaagttagagaagttgccatgtcaaagaactatattgctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggttctgcttcaagaacagaatttgggaattaggtataagttcaatgttcccatcactcgaactggcagtggagataatgaagttggctttacatggaatcatcagccttggtcagaatgctcagctacttgtgctggaggtgtccaaagacaggaggtggtctgtaaaaggttggatgacaactccattgtccagaacaattactgtgatcctgacagtaagccacctgaaaatcaaagagcctgcaacactgagccctgcccacctgagtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaatttaaattataaaacgggctttgaactataatttaaggagcaattataaatcaaaagtaatgaaagtttgtattatttttcttcattccacttaatttccttaggaataatcccctggttctgaacactgctgtgagccatatataaaactatattaaactgaacaataatgaggggcatagtttaaagcagtgcatcagttactgcagctgtgcaagtctataaactcagtgctgaaagactgtggccaacttgccattgtgcaagtaaagctgagatttccattaaaactttaagagaaaaacatttcaatttcatgcagaaaccagacctggggtatggtacagaccaaaggaccaggccctttgctgccaccacacaggatgccttagttcttatttgagtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataataatg

SEQ ID NO: 104759 - DNA, 5490 bp, Homo sapiens
  Payload ID: 573
  Gene Symbol: ADAMTS7
  Gene Name: ADAM metallopeptidase with thrombospondin type 1 motif, 7
  Uniprot ID: Q9UKP4
  ENST ID: ENST00000388820
  CDS Start-End: 212-5272
cttttctttgcctctgcagcggccaagggggcgggccctgcagcctttgttgcccgcggaccgagcgcagccgaacggagtcggggccgggtcgccgggagctgcacgccggccgggcatgtcctgagccggacctgggaccaggcagcgaccggacgggacggacgagagcgtgcgcgcggggtcacccggcggccgcccggttcctgccatgcccggcggccccagtccccgcagccccgcgcctttgctgcgccccctcctcctgctcctctgcgctctggctcccggcgcccccggacccgcaccaggacgtgcaaccgagggccgggcggcactggacatcgtgcacccggttcgagtcgacgcggggggctccttcctgtcctacgagctgtggccccgcgcactgcgcaagcgggatgtatctgtgcgccgagacgcgcccgccttctacgagctacaataccgcgggcgcgagctgcgcttcaacctgaccgccaatcagcacctgctggcgcccggctttgtgagcgagacgcggcggcgcggcggcctgggccgcgcgcacatccgggcccacaccccggcctgccacctgcttggcgaggtgcaggaccctgagctcgagggtggcctggcggccatcagcgcctgcgacggcctgaaaggtgtgttccagctctccaacgaggactacttcattgagcccctggacagtgccccggcccggcctggccacgcccagccccatgtggtgtacaagcgtcaggccccggagaggctggcacagcggggtgattccagtgctccaagcacctgtggagtgcaagtgtacccagagctggagtctcgacgggagcgttgggagcagcggcagcagtggcggcggccacggctgaggcgtctacaccagcggtcggtcagcaaagagaagtgggtggagaccctggtagtagctgatgccaaaatggtggagtaccacggacagccgcaggttgagagctatgtgctgaccatcatgaacatggtggctggcctgtttcatgaccccagcattgggaaccccatccacatcaccattgtgcgcctggtcctgctggaagatgaggaggaggacctaaagatcacgcaccatgcagacaacaccctgaagagcttctgcaagtggcagaaaagcatcaacatgaagggggatgcccatcccctgcaccatgacactgccatcctgctcaccagaaaggacctgtgtgcagccatgaaccggccctgtgagaccctgggactgtcccatgtggcgggcatgtgccagccgcaccgcagctgcagcatcaacgaggacacgggcctgccgctggccttcactgtagcccacgagctcgggcacagttttggcattcagcatgacggaagcggcaatgactgtgagcccgttgggaaacgacctttcatcatgtctccacagctcctgtacgacgccgctcccctcacctggtcccgctgcagccgccagtatatcaccaggttccttgaccgtgggtggggcctgtgcctggacgaccctcctgccaaggacattatcgacttcccctcggtgccacctggcgtcctctatgatgtaagccaccagtgccgcctccagtacggggcctactctgccttctgcgaggacatggataatgtctgccacacactctggtgctctgtggggaccacctgtcactccaagctggatgcagctgtggacggcacccggtgtggggagaataagtggtgtctcagtggggagtgcgtacccgtgggcttccggcccgaggccgtggatggtggctggtctggctggagcgcctggtccatctgctcacggagctgtggcatgggcgtacagagcgccgagcggcagtgcacgcagcctacgcccaaatacaaaggcagatactgtgtgggtgagcgcaagcgcttccgcctctgcaacctgcaggcctgccctgctggccgcccctccttccgccacgtccagtgcagccactttgacgctatgctctacaagggccagctgcacacatgggtgcccgtggtcaatgacgtgaacccctgcgagctgcactgccggcccgcgaatgagtactttgccgagaagctgcgggacgccgtggtcgatggcaccccctgctaccaggtccgagccagccgggacctctgcatcaacggcatctgtaagaacgtgggctgtgacttcgagattgactccggtgctatggaggaccgctgtggtgtgtgccacggcaacggctccacctgccacaccgtgagcgggaccttcgaggaggccgagggcctggggtatgtggatgtggggctgatcccagcgggcgcacgcgagatccgcatccaagaggttgccgaggctgccaacttcctggcactgcggagcgaggacccggagaagtacttcctcaatggtggctggaccatccagtggaacggggactaccaggtggcagggaccaccttcacatacgcacgcaggggcaactgggagaacctcacgtccccgggtcccaccaaggagcctgtctggatccagctgctgttccaggagagcaaccctggggtgcactacgagtacaccatccacagggaggcaggtggccacgacgaggtcccgccgcccgtgttctcctggcattatgggccctggaccaagtgcacagtcacctgcggcagaggtgtgcagaggcagaatgtgtactgcttggagcggcaggcagggcccgtggacgaggagcactgtgaccccctgggccggcctgatgaccaacagaggaagtgcagcgagcagccctgccctgccaggtggtgggcaggtgagtggcagctgtgctccagctcctgcgggcctgggggcctctcccgccgggccgtgctctgcatccgcagcgtggggctggatgagcagagcgccctggagccacccgcctgtgaacaccttccccggccccctactgaaaccccttgcaaccgccatgtaccctgtccggccacctgggctgtggggaactggtctcagtgctcagtgacatgtggggagggcactcagcgccgaaatgtcctctgcaccaatgacaccggtgtcccctgtgacgaggcccagcagccagccagcgaagtcacctgctctctgccactctgtcggtggcccctgggcacactgggccctgaaggctcaggcagcggctcctccagccacgagctcttcaacgaggctgacttcatcccgcaccacctggccccacgcccttcacccgcctcatcacccaagccaggcaccatgggcaacgccattgaggaggaggctccagagctggacctgccggggcccgtgtttgtggacgacttctactacgactacaatttcatcaatttccacgaggatctgtcctacgggccctctgaggagcccgatctagacctggcggggacaggggaccggacacccccaccacacagccatcctgctgcgccctccacgggtagccccgtgcctgccacagagcctcctgcagccaaggaggagggggtactgggaccttggtccccgagcccttggcctagccaggccggccgctccccacccccaccctcagagcagacccctgggaaccctttgatcaatttcctgcctgaggaagacacccccataggggccccagatcttgggctccccagcctgtcctggcccagggtttccactgatggcctgcagacacctgccacccctgagagccaaaatgatttcccagttggcaaggacagccagagccagctgccccctccatggcgggacaggaccaatgaggttttcaaggatgatgaggaacccaagggccgaggagcaccccacctgcccccgagacccagctccacgctgccccctttgtcccctgttggcagcacccactcctctcctagtcctgacgtggcggagctgtggacaggaggcacagtggcctgggagccagctctggagggtggcctggggcctgtggacagtgaactgtggcccactgttggggtggcttctctccttcctcctcccatagcccctctgccagagatgaaggtcagggacagttccctggagccggggactccctccttcccaaccccaggaccaggctcatgggacctgcagactgtggcagtgtgggggaccttcctccccacaaccctgactggcctcgggcacatgcctgagcctgccctgaacccaggacccaagggtcagcctgagtccctcagccctgaggtgcccctgagctctaggctgctgtccacaccagcttgggacagccccgccaacagccacagagtccctgagacccagccgctggctcccagcctggctgaagcggggccccccgcggacccgttggttgtcaggaacgccggctggcaagcgggaaactggagcgagtgctctaccacctgtggcctgggtgcggtctggaggccggtgcgctgtagctccggccgggatgaggactgcgcccccgctggccggccccagcctgcccgccgctgccacctgcggccctgtgccacctggcactcaggcaactggagtaagtgctcccgcagctgcggcggaggttcctcagtgcgggacgtgcagtgtgtggacacacgggacctccggccactgcggcccttccattgtcagcccgggcctgccaagccgcctgcgcaccggccctgcggggcccagccctgcctcagctggtacacatcttcctggagggagtgctccgaggcctgtggcggtggtgagcagcagcgtctagtgacctgcccggagccaggcctctgcgaggaggcgctgagacccaacaccacccggccctgcaacacccacccctgcacgcagtgggtggtggggccctggggccagtgctcaggcccctgtggtggtggtgtccagcggcgcctggtcaagtgtgtcaacacccagacagggctgcccgaggaagacagtgaccagtgtggccacgaggcctggcctgagagctcccggccgtgtggcaccgaggattgtgagcccgtcgagcctccccgctgtgagcgggaccgcctgtccttcgggttctgcgagacgctgcgcctactgggccgctgccagctgcccaccatccgcacccagtgctgccgctcgtgctctccgcccagccacggcgccccctcccgaggccatcagcgggttgcccgccgctgactgcgccaggatgcacagaccgaccgacagacctcagtgcccaccacgggctgtggcggagctcccgccccctgcgccctaatggtgctaaccccctctcactacccagcagcaggctggggacctcctccccctcaaaaaaggtatttttttattctaacagtttgtgtaacatttattatgattttacataaatgagcatctaccattccaaagca

SEQ ID NO: 104760 - DNA, 4010 bp, Homo sapiens
  Payload ID: 574
  Gene Symbol: ADAMTS8
  Gene Name: ADAM metallopeptidase with thrombospondin type 1 motif, 8
  Uniprot ID: Q9UP79
  ENST ID: ENST00000257359
  CDS Start-End: 708-3377
acagggtcgctgagaccagtgcacgagcctcttcggaagatgcatcctggactcttggccgcagaggagaaagcggttggggtctcccagggactctttctaaagggtcagtccagcatggtaggggttaacgtgggtccacgcgtagagggaaaggaaagaagttgtagttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggccgagtcggccttgcacccgattgattccgcttttcctggagagagcggccgggccgcgctcgggccgccagcacctgcccgcgcctggcgggcttcttccctctcctgcgcgcagccaccgccgcagcccccatgctccccgcccccgccgccccccggtggcctccgctcctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgctgcgcctggcgcccgacgacagcttcctagcgcccgagttcaagatcgagcgcctcgggggctccggccgggcgaccgggggcgagcgggggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctgctgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggcagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgcc

SEQ ID NO: 104761 - DNA, 7060 bp, Homo sapiens
  Payload ID: 575
  Gene Symbol: ADAMTS9
  Gene Name: ADAM metallopeptidase with thrombospondin type 1 motif, 9
  Uniprot ID: Q9P2N4
  ENST ID: ENST00000295903
  CDS Start-End: 23-5746
ggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaa

SEQ ID NO: 104762 - DNA, 3168 bp, Homo sapiens
  Payload ID: 575
  Gene Symbol: ADAMTS9
  Gene Name: ADAM metallopeptidase with thrombospondin type 1 motif, 9
  ENST ID: ENST00000481060
  CDS Start-End: 1-2975
gtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggaaaattgcctccagctgcatccatattgctgcaaaggacatgatttcattattttttatggctgcatagtatttcatcatgtatacagaccacatttttaaaatccagtccaccattaatcggtacctaggttgattccacgtttgctattgtgaatagtgctgcaataaacatgtgagtgcaggtg

SEQ ID NO: 104763 - DNA, 7624 bp, Homo sapiens
  Payload ID: 575
  Gene Symbol: ADAMTS9
  Gene Name: ADAM metallopeptidase with thrombospondin type 1 motif, 9
  Uniprot ID: Q9P2N4
  ENST ID: ENST00000498707
  CDS Start-End: 344-6151
acagggcgcccggcgcgcctcggagcgcaagttcctcgccttctcctgcccgctcgctgggcattatgcggccaagcagccgagccccagtcctcctcctcctcctgctcctccggctcctcctgcggcccgagcggctcagctctcggcaggcggcggcgttgctcagccgagcgcagacgggaccctcgcagcgagacctcagcgactcctaaagtcaaaagttggcggcgggcgccgggctccgcgcgctctccacggccgctgcctcgcgtcgccgccgcagccaaggagggcaggagggaggggggtgggggcagcggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaa

SEQ ID NO: 104764 - DNA, 2871 bp, Homo sapiens
  Payload ID: 575
  Gene Symbol: ADAMTS9
  Gene Name: ADAM metallopeptidase with thrombospondin type 1 motif, 9
  ENST ID: ENST00000459780
  CDS Start-End: 334-1800
cggcgcgcctcggagcgcaagttcctcgccttctcctgcccgctcgctgggcattatgcggccaagcagccgagccccagtcctcctcctcctcctgctcctccggctcctcctgcggcccgagcggctcagctctcggcaggcggcggcgttgctcagccgagcgcagacgggaccctcgcagcgagacctcagcgactcctaaagtcaaaagttggcggcgggcgccgggctccgcgcgctctccacggccgctgcctcgcgtcgccgccgcagccaaggagggcaggagggaggggggtgggggcagcggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagagtaagacttgaacattcttttagcacaaacttctagtgcctggcctacatgtagtgaactaattgtgggaaagacaatatgaagtcaaacattccttttgagttatttttgttgacattccttggagaaggcaaaaaaaaaaaaaaaaagctctctgacatctgtgtagttcatatccttgacagagtttagaagattacagactgagctaaagaaaaggttggagtcttaaagaggatgtggaaatgttgcttcattttgggtaaagttttgagatttgttcagacattgggagagggactatgaatgtgatttcttaatgaaggccacaggtatttatgcacttctaatttagtaatttgggcctgaaaaggggtggggtagtgagatgatcccaaagcagattccgtggatgagtggaaattacagcagctcccacattgttgagttgaggacattctctctctgcgtcactcttcctctccccctcttccctctcccttttctcttttttcccatttcctttcttttcttgttttgttttttaagcttcctgctaggctgctcaaagatccaattacattatacaatgcccctgtgtcacagatttattgctcttctcgctcagaagtatgaaaggttaagtgattgtcccagagtcactgggtgtatatttctgcaaccacggggaagaggaggctttatcaatcagaactcaacgggtgtgaattttccgggagaggtgtttgctgaaaacggaaagaaccagagggttgctgttgttctttttaaccagatggtgtaaggtgttttctttctatgagtcattgattcgctcacgcatcccttcagcaaacatttactaatcacctgttgtcatggacagggccctgtgctttgatgaaaaagacactatctttgcccttagaaagcttacagtctattgggaaagatagtcaaacataaacagataattgctgtgaagtgtgatcaacgttgtaacaggtgtatatttcctactggctatgttgtattcattgcatgtggttctacaaagtaaacagcaaaaatgtaa

SEQ ID NO: 104765 - DNA, 597 bp, Homo sapiens
  Payload ID: 575
  Gene Symbol: ADAMTS9
  Gene Name: ADAM metallopeptidase with thrombospondin type 1 motif, 9
  ENST ID: ENST00000467257
  CDS Start-End: 1-210
gccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggaaaattgcctccagctgcatccatattgctgcaaaggacatgatttcattattttttatggctgcatagtatttcatcatgtatacagaccacatttttaaaatccagtccaccattaatcggtacctaggttgattccacgtttgctattgtgaatagtgctgcaataaacatgtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaa

SEQ ID NO: 104766 - DNA, 2348 bp, Homo sapiens
  Payload ID: 576
  Gene Symbol: ADAMDEC1
  Gene Name: ADAM-like, decysin 1
  Uniprot ID: O15204
  ENST ID: ENST00000256412
  CDS Start-End: 221-1633
agatgtgagtcctcaatgagctataaccacagccataaatatctctcaaagatgaggaacattctcatgatgttgacactgcaattttttgacaatttcccaacactcttaagaaacattccccaatctcacacgaaaagtgggggttttaattttcttgttcaacttctaaagagaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcaagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 104767 - DNA, 2044 bp, Homo sapiens
  Payload ID: 576
  Gene Symbol: ADAMDEC1
  Gene Name: ADAM-like, decysin 1
  Uniprot ID: O15204
  ENST ID: ENST00000522298
  CDS Start-End: 154-1329
aagataaaactggacactggggagaccacaacttcatgctgcgtgggatctcccagctacctgcagtggccaccatgtcttgggtcctgctgcctgtactttggctcattgttcaaactcaaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcaagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 104768 - DNA, 1922 bp, Homo sapiens
  Payload ID: 576
  Gene Symbol: ADAMDEC1
  Gene Name: ADAM-like, decysin 1
  ENST ID: ENST00000520193
  CDS Start-End: 1-126
atgctgcgtgggatctcccagctacctgcagtggccaccatgtcttgggtcctgctgcctgtactttggctcattgttcaaactcaagcctcaaactgtgcgtggcctaaagtcagcattcaataaatatttgtgaaatgaatatttcagttttcacataaaagaaatatcagagaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccac

SEQ ID NO: 104769 - DNA, 2906 bp, Homo sapiens
  Payload ID: 577
  Gene Symbol: ADAMTSL1
  Gene Name: ADAMTS-like 1
  Uniprot ID: Q8N6G6
  ENST ID: ENST00000276935
  CDS Start-End: 1-2052
atggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgttcatcccagaggcctggtcggcctgcacagtcacctgtggtgtggggacccaggtgcgaatagtcaggtgccaggtgctcctgtctttctctcagtccgtggctgacctgcctattgacgagtgtgaagggcccaagccagcatcccagcgtgcctgttatgcaggcccatgcagcggggaaattcctgagttcaacccagacgagacagatgggctctttggtggcctgcaggatttcgacgagctgtatgactgggagtatgaggggttcaccaagtgctccgagtcctgtggaggaggtgtccaggaggctgtggtgagctgcttgaacaaacagactcgggagcctgctgaggagaacctgtgcgtgaccagccgccggcccccacagctcctgaagtcctgcaatttggatccctgcccagcaagaagcagtatcgactcagcatggaacgcctgcaacgttctttgttaggcaaccaagaggcctggcttctcatcctgctgtcaccaactagctctgtggcctagggcgaggtgtctgccctttatgtttccacatctgcaaagtgaactggttgtacctgatgatctgagatcccatgacttgctcacatgtcccatgattctttattttgtaggcagaagcattaaacagctactcctgctgctgtgtgctaatcattcctgtaatttctgttctgcttatttgccattatttgaaaaacatgcaaaagggtctttctaaccacattcctgtgttgtaacaacacccaaatgctgaggcagtgccgaggagtcagtgcctgggacttgcttaaaactgctgggactcgtggtccctaaacccttctttgagcaccaaaacgaataggacatgagatgttacttctcattctcaaagtactaactatgtttaagttacaaaaggttaggttatcctgtgacccttttgttgactcacagacaagaacagttgttgagcttaatgttgtcgcatttgctccagataaactcaattctctgatttcccaccagccagctgtcaagccaacaggcaagacctctcactgggcacagccaggagtttcttgggtcgaccatacacatttaaacatttgtagaaggttgctaattgcaacaataaaggggaccaaagtataatggcctaatctcatccaagagtcaaaacagattttccccctaaaaatgataattgtatagaggtgcctttcctgtggaatatctcactctgatgtcagagaaaaatctctccttcccttctcctggtgttcaatgtatacagaaaataaaatgtgtttggtagga

SEQ ID NO: 104770 - DNA, 1864 bp, Homo sapiens
  Payload ID: 577
  Gene Symbol: ADAMTSL1
  Gene Name: ADAMTS-like 1
  Uniprot ID: Q8N6G6
  ENST ID: ENST00000327883
  CDS Start-End: 134-1711
aaatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgtaagttgtaaaagcacagactgttctatatttgaaactgttttgtttaaagaaagcagtgtctcactggttgtagctttcatgggttctgaactaagtgtaatcatctcaccaaagctttttggctctcaaattaaagattgattagtttcaaaaa

SEQ ID NO: 104771 - DNA, 686 bp, Homo sapiens
  Payload ID: 577
  Gene Symbol: ADAMTSL1
  Gene Name: ADAMTS-like 1
  ENST ID: ENST00000380538
  CDS Start-End: 1-453
acgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcgctgagtcataaggagcagctgaaaccaggagagattcgatgaaatatgaaacatgctcattaatatcagcagtttgacttgctgacgggaaggtttccacaggaatgattaatgtccttttatacccttcctgaactgtaacatagcctggcccgctcctttctcaaaccccccccaccccagctcctgaaaaattgctgaaacgtatatttggaaataaaagttgatggaaatgca

SEQ ID NO: 104772 - DNA, 1562 bp, Homo sapiens
  Payload ID: 577
  Gene Symbol: ADAMTSL1
  Gene Name: ADAMTS-like 1
  Uniprot ID: Q8N6G6
  ENST ID: ENST00000380545
  CDS Start-End: 110-1501
atttaatctggccaaagcctggtagaagatgtccctgtagagcagccccagggaagggggattcaagaagctataaatgcctctgggctcacctgaatgtgtttgactgatgagtggggttttttgttttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcggtggatggtgacctcctggtctgcctgtacccggagctgtgggggaggtgtccagacccgcagggtgacctgtcaaaagctgaaagcctctgggatctccacccctgtgtccaatgacatgtgcacccaggtcgccaagcggcctgtggacacccaggcctgtaaccagcagctgtgtgtggagtgggccttctccagctggggccagtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcgg

SEQ ID NO: 104773 - DNA, 8030 bp, Homo sapiens
  Payload ID: 577
  Gene Symbol: ADAMTSL1
  Gene Name: ADAMTS-like 1
  Uniprot ID: Q8N6G6
  ENST ID: ENST00000380548
  CDS Start-End: 340-5628
tttcccttctcgctctgctgctcgctcgcctttctttttcgtccttttcccccttttttgctcgcaccgttacactttctctgtcctcctggctttgttattcagcatgtctgattagcaggagcctgattggctggctgcctgctccgagagagattccattcagcttaccccccacccatccacccacccacccctcggtcaggaaatgtgagaggggctgatggaagctgataggcaggactggagtgttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccagtgacggatacaagcagatcatgccttatgacctctaccatccccttcctcggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccgtgcacagtgacatgtggccagggcctcagataccgtgtggtcctctgcatcgaccatcgaggaatgcacacaggaggctgtagcccaaaaacaaagccccacataaaagaggaatgcatcgtacccactccctgctataaacccaaagagaaacttccagtcgaggccaagttgccatggttcaaacaagctcaagagctagaagaaggagctgctgtgtcagaggagccctcgttcatcccagaggcctggtcggcctgcacagtcacctgtggtgtggggacccaggtgcgaatagtcaggtgccaggtgctcctgtctttctctcagtccgtggctgacctgcctattgacgagtgtgaagggcccaagccagcatcccagcgtgcctgttatgcaggcccatgcagcggggaaattcctgagttcaacccagacgagacagatgggctctttggtggcctgcaggatttcgacgagctgtatgactgggagtatgaggggttcaccaagtgctccgagtcctgtggaggaggtgtccaggaggctgtggtgagctgcttgaacaaacagactcgggagcctgctgaggagaacctgtgcgtgaccagccgccggcccccacagctcctgaagtcctgcaatttggatccctgcccagcaaggtgggaaattggcaagtggagtccatgtagtctcacatgtggggtcggcctacagaccagagacgtcttctgcagccacctgctttccagagagatgaatgaaacagtcatcctggctgatgagctgtgtcgccagcccaagcccagcacggtgcaagcttgtaaccgctttaattgccccccagcctggtaccctgcacagtggcagccgtgttccagaacgtgtggcgggggtgttcagaaacgtgaggttctttgcaagcagcgcatggctgatggcagcttcctggagcttcctgagaccttctgttcagcttcaaaacctgcctgccagcaagcatgcaagaaagatgactgtcccagcgagtggcttctctcagactggacagagtgttccacaagctgcggggaaggcacccagactcgaagcgccatttgccgaaagatgctgaaaaccggcctctcaacggttgtcaattccaccctgtgcccgcccctgcctttctcttcctccatcaggccctgtatgctggcaacctgtgcaaggcccgggcggccatccacgaagcacagcccgcacatcgcggccgccaggaaggtctacatacagactcgcaggcagaggaagctgcacttcgtggtggggggcttcgcctacctgctccccaagacggcggtggtgctgcgctgcccggcgcgcagggtccgcaagcccctcatcacctgggagaaggacggccagcacctcatcagctcgacgcacgtcacggtggcccccttcggctatctcaagatccaccgcctcaagccctcggatgcaggcgtctacacctgctcagcgggcccggcccgggagcactttgtgattaagctcatcggaggcaaccgcaagctcgtggcccggcccttgagcccgagaagtgaggaagaggtgcttgcggggaggaagggcggcccgaaggaggccctgcagacccacaaacaccagaacgggatcttctccaacggcagcaaggcggagaagcggggcctggccgccaacccggggagccgctacgacgacctcgtctcccggctgctggagcagggcggctggcccggagagctgctggcctcgtgggaggcgcaggactctgcggaaaggaacacgacctcggaggaggacccgggtgcagagcaagtgctcctgcacctgcccttcaccatggtgaccgagcagcggcgcctggacgacatcctggggaacctctcccagcagcccgaggagctgcgcgacctctacagcaagcacctggtggcccagctggcccaggagatcttccgcagccacctggagcaccaggacacgctcctgaagccctcggagcgcaggacttccccagtgactctctcgcctcataaacacgtgtctggcttcagcagctccctgcggacctcctccaccggggacgccgggggaggctctcgaaggccacaccgcaagcccaccatcctgcgcaagatctcagcggcccagcagctctcagcctcggaggtggtcacccacctggggcagacggtggccctggccagcgggacactgagtgttcttctgcactgtgaggccatcggccacccaaggcctaccatcagctgggccaggaatggagaagaagttcagttcagtgacaggattcttctacagccagatgattccttacagatcttggcaccagtggaagcagatgtgggtttctacacttgcaatgccaccaatgccttgggatacgactctgtctccattgccgtcacattagcaggaaagccactagtgaaaacgtcacgaatgacagtgatcaacacggagaagcctgcagtcacagtcgatataggaagcaccatcaaaacagtgcagggagtgaatgtgacaatcaactgccaggttgcaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcggtggatggtgacctcctggtctgcctgtacccggagctgtgggggaggtgtccagacccgcagggtgacctgtcaaaagctgaaagcctctgggatctccacccctgtgtccaatgacatgtgcacccaggtcgccaagcggcctgtggacacccaggcctgtaaccagcagctgtgtgtggagtgggccttctccagctggggccagtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaagctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggttgtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttctatgtctgtatatcttttgtgaatatttattaggatttcttattaaaaaagtgcaatattaataattgtacattgtcatccagaaacaaaactattggggggactttattaactaacttcctgcagttgtgttcctgtaaactcagtagtgattattatatttttcctatttttaatagaacctggtgtttaactctggatccattcactgtacaggatgtgttgtaaaaactaacatgggatgctgaggcagtaagagggaattcatttgtggcataatagttatgcatggaatgataaagacagacaaattccatactactactaatgtggttaattatttctagttcgatagtgattgaaaatcagtggtcactatttacatttcctaaagagcaagcatcctccagctccatgttgggttggagcagttggcagtgggtctcagtgagctggcagaacctaggtttgggtgggaagcagaatgctcgttgcatgaaatgaatgtacatttaatgtttgttctgtgaattgcaactcagcagcaccacaagacaatgaaggctgctggctaatgtggaaggaggcactttctcctctaaaacacaaaactgtatttgtattttttgtacagataatacagcttatttatttaaa

SEQ ID NO: 104774 - DNA, 2321 bp, Homo sapiens
  Payload ID: 577
  Gene Symbol: ADAMTSL1
  Gene Name: ADAMTS-like 1
  Uniprot ID: Q8N6G6
  ENST ID: ENST00000380566
  CDS Start-End: 65-1384
gcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatcggatgatactgtggttgcaattccctatggaagtagacatattcgccttgtcttaaaaggtcctgatcacttatatctggaaaccaaaaccctccaggggactaaaggtgaaaacagtctcagctccacaggaactttccttgtggacaattctagtgtggacttccagaaatttccagacaaagagatactgagaatggctggaccactcacagcagatttcattgtcaagattcgtaactcgggctccgctgacagtacagtccagttcatcttctatcaacccatcatccaccgatggagggagacggatttctttccttgctcagcaacctgtggaggaggttatcagctgacatcggctgagtgctacgatctgaggagcaaccgtgtggttgctgaccaatactgtcactattacccagagaacatcaaacccaaacccaagcttcaggagtgcaacttggatccttgtccagccaggtgggaggccaccccatggaccgcgtgctcctcctcgtgtggggggggcatccagagccgggcagtttcctgtgtggaggaggacatccaggggcatgtcacttcagtggaagagtggaaatgcatgtacacccctaagatgcccatcgcgcagccctgcaacatttttgactgccctaaatggctggcacaggagtggtctccggtaactgtgccttctttctttgttcattaggagagtaagtccactcttccctctcatcatcatggccccaccgggtaccctgagcagctccacactcttcttgaggtgtctagaagcctaccagcttagctcctggagtaggaatgccccaaatccagcatgaccaaaagtaaatgatgtttttttaaagtgtctttcttcaagtttcttcaagaagcctctattgttccccagataatgttccctcaaatagcacggggaagcaactgcctttcaagggtaattgaggctgaatgaatgatcccgaatctgtaaaagctgctttgatgatagagctcagtagaccagaagtttgatttcattttgtatgtattatgctttgtatccgaaagggtctaagtggattaatattaaaactatgtatattaatcattggagaagggggaagaggaaatgaaaatagcacaaaaattaaaattggaacgaagtaagataattaaaacaaaaaacttatagatgttaggaaacctgctgtaattaaacataaaatgtcattcagggtttcctgactgctaatgcagaaaggaaaatcgtaaaggaaacagaaagatgaaataagccattgtgccctccgcctcagaaatgacaaaagactcttcactgagccctgtggcttcatggcagcagatcagagctgtgacattttctacatctagacatgctaccagacatggggaaccattagaggtgcaatctacattgggcatctggtcattcaatctgtttttttaaatgttatttttgcctttcaatgtaatcaattggattaacaatgctgcaatataatttagctataatcgtagtttaaattttttgatatccatgtaggggtatttcccatatttttggaagtagcggtcattagcaaagtaactaaataaaatacagtgctggtagtcaaaattaa

SEQ ID NO: 104775 - DNA, 931 bp, Homo sapiens
  Payload ID: 577
  Gene Symbol: ADAMTSL1
  Gene Name: ADAMTS-like 1
  ENST ID: ENST00000380570
  CDS Start-End: 81-740
agtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaaattgttggctgcgatcaccagctgggaagcaccgtcaaggaagataactgtggggtctgcaacggagatgggtccacctgccggctggtccgagggcagtataaatcccagctctccgcaaccaaatgtaagacacacagagatgggcgacctttggacttgttgacttatcctctcctggcttaggtctggccccactaaacagccagggaacaacacctccaccaaaacgataatgaacctgaaaatgtagaaggcttcatgctctggcatgtgaattagcttaggtgggacaagtcaggttaccagctgcagtcccaaagaggaagcctgtccttctgaggcacatcaggagtgaaccagacatggggctacaa

SEQ ID NO: 104776 - DNA, 1163 bp, Homo sapiens
  Payload ID: 577
  Gene Symbol: ADAMTSL1
  Gene Name: ADAMTS-like 1
  ENST ID: ENST00000388710
  CDS Start-End: 100-927
gccaaagcctggtagaagatgtccctgtagagcagccccagggaagggggattcaagaagctataaatgcctctgggctcacctgaatgtgtttgactgatgagtggggttttttgttttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcgg

SEQ ID NO: 104777 - DNA, 824 bp, Homo sapiens
  Payload ID: 577
  Gene Symbol: ADAMTSL1
  Gene Name: ADAMTS-like 1
  ENST ID: ENST00000431052
  CDS Start-End: 90-647
gttagcaccagtactggatgtgacagcaggcagaggagcacttagcagcttattcagtgtccgattctgattccggcaaggatccaagcatggaatgctgccgtcgggcaactcctggcacactgctcctctttctggctttcctgctcctgagttccaggaccgcacgctccgaggaggaccgggacggcctatgggatgcctggggcccatggagtgaatgctcacgcacctgcgggggtggggcctcctactctctgaggcgctgcctgagcagcaagagctgtgaaggaagaaatatccgatacagaacatgcagtaatgtggactgcccaccagaagcaggtgatttccgagctcagcaatgctcagctcataatgatgtcaagcaccatggccagttttatgaatggcttcctgtgtctaatgaccctgacaacccatgttcactcaagtgccaagccaaaggaacaaccctggttgttgaactagcacctaaggtcttagatggtacgcgttgctatacagaatctttggatatgtgcatcagtggtttatgccaagtaagtgctgatttgttctcattcaacttgtccagagggtttcaatgtctttgtgtaaatggtttacatagtctcactctctgaatcactcatctttacactttttagagtttgtaaatggtgaaagatttgaaaattaaggtatgatttcagtgaaaagtaccaagtgttgtattgtgcgaaggaaaagtagactagagttatttttctttccttgagtgtcacttgaatataaaagaataaaaatttttgaatagtgtt

SEQ ID NO: 104778 - DNA, 3039 bp, Homo sapiens
  Payload ID: 577
  Gene Symbol: ADAMTSL1
  Gene Name: ADAMTS-like 1
  Uniprot ID: Q8N6G6
  ENST ID: ENST00000542621
  CDS Start-End: 110-886
atttaatctggccaaagcctggtagaagatgtccctgtagagcagccccagggaagggggattcaagaagctataaatgcctctgggctcacctgaatgtgtttgactgatgagtggggttttttgttttttttttttcttcctaggagtgcctgaagctgaagtcacttggttcaggaataaaagcaaactgggctccccgcaccatctgcacgaaggctccttgctgctcacaaacgtgtcctcctcggatcagggcctgtactcctgcagggcggccaatcttcatggagagctgactgagagcacccagctgctgatcctagatcccccccaagtccccacacagttggaagacatcagggccttgctcgctgccactggaccgaaccttccttcagtgctgacgtctcctctgggaacacagctggtcctggatcctgggaattctgctctccttggctgccccatcaaaggtcaccctgtccctaatatcacctggtttcatggtggtcagccaattgtcactgccacaggactgacgcatcacatcttggcagctggacagatccttcaagttgcaaaccttagcggtgggtctcaaggggaattcagctgccttgctcagaatgaggcaggggtgctcatgcagaaggcatctttagtgatccaagattactggtggtctgtggacagactggcaacctgctcagcctcctgtggtaaccggggggttcagcagccccgcttgaggtgcctgctgaacagcacggaggtcaaccctgcccactgcgcagggaaggttcgccctgcggtgcagcccatcgcgtgcaaccggagagactgcccttctcgtgcaatgggccttgcatcgggcctcacctagctgtgcaacacagacaagtcttctgccagacacgggatggcatcaccttaccatcagagcagtgcagtgctcttccgaggcctgtgagcacccagaactgctggtcagaggcctgcagtgtacactggagagtcagcctgtggaccctgtgcacagctacctgtggcaactacggcttccagtcccggcgtgtggagtgtgtgcatgcccgcaccaacaaggcagtgcctgagcacctgtgctcctgggggccccggcctgccaactggcagcgctgcaacatcaccccatgtgaaaacatggagtgcagagacaccaccaggtactgcgagaaggtgaaacagctgaaactctgccaactcagccagtttaaatctcgctgctgtggaacttgtggcaaagcgtgaagatagggtgtggggaaaaactctaccctggccacacgaaggactcacgcaaccacctcggacagaacctaagctttcttcattttatttatttatttccccctccccactccacacacacccttccaacctcctccacctccaccttcaagcataaggacgtccgcgtgttttctctttcagttagctggaggacaggatgttgggaaaggaaaggacagatgtctaaaggaggttgcagagcaggccaggcagacagtgggggctcccttgaagagcttcctccctcccaaacctgggtctcaaagacctagaaagaggcaggcacagcccctgcggacagcagggagccagaaggtttgtagcctattggtgcaaacattggacaaattcctgtgtctttcctagaagcgcactatcacaaacacaggagtgttttgctcctttgtctcctcttccccatctatgtccctttagtcacagttaggacaaatggggaggggacaccatgctgaggcagaaactagcccagaactcactcagttcttctagtgggtgagtgcagagagagaagaactcagatcaccagtagggagaggtaaaaaagcaaacaaagcaggctctaaggcacacaacattgcagaaaatgaggaagggaggggagggaagggacagaagcaaaaaggagcctgtggtgttccccagtggggcagggtgagcaggggcttccaggctgcatgaggctcatggaccagctctgatcccatgcatgtgcgcatgctcagagccctgctgcccacaacagagcactgcgctgcgtgggagtccccacttcccaagctatcagagtcaacgtcctgcctgtgcagctgcagcaaagccagtgagaggtgggtctcgccatgcagtaaggccaccctggcacctctttatctaaatccgaagtcccctagccccgcactaactaactgctgctgtgggccagggccattttgagcatgaatggcccaggttttttgccttctaggacctttgctgctccaccgaagggccagggactatggttaacttatcaacatcaacccattaactagtcactgtgccagagagtatctgtcaggctgtcaggttgtagcaacctcttcattccagagctggcccagggaccggggtgggacaatgggtttatgcgtgtccacagtacaccctccctctcccagcctccaccccagggtctgcaggtcctccggcatgtagtatttatctagcaaggcggggtggtggaggcagcaccctggcaaagcagctcacacactgcagccacactcatcagctgtggtgaggcggctggagcaaagtcaaagtcatgcagcaaaatgaaaactctgggactcttcggcaaaatcctcattaagccgagcagctttggccaagtaatttttgcctccttccctcgcgtggcctgagtttaggagcaagggtggccagagtcccttacccacagataagcctcccctcatgaaatgccactcaccccgggctaccattgacatcagggctgcatttccagccagcctggaagtaaaatttgagaggaagacaatattaatctgtgtccccacctagtgagctgtggacaggtttaagttgggtctccttcttcttcaccacaaaaacaggctctaagaaatcatgttactaaaaaatcagtgtaaagtctgtttaaaataaaaaagaatgttttct

SEQ ID NO: 104779 - DNA, 4068 bp, Homo sapiens
  Payload ID: 578
  Gene Symbol: ADAMTSL2
  Gene Name: ADAMTS-like 2
  Uniprot ID: Q86TH1
  ENST ID: ENST00000354484
  CDS Start-End: 558-3413
cactggcggagaaaatccccttcttttttttctctctctttttttctttttgagacggaatctcactctttcacccagactggagggcagcggcgagatctcggctcactgcaacctccacctcccaggttcaagcaattctcctgcctcagccttccgagtagctgggattacaggtgcccgccaccacgcccagctaatttttgtatttttagtagagacaggattttaccatgttggccatgctggtctcaaactcctgacctcgtgtgatccccctgcttcagcctctcaaactgctgggattataggcatgagccactgcgcctggccaacaatccccttctaaaggcaggtggtgtctccagcaccagggccatacggctgcaacacccctacaagtgccgggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagacgaagctggctactacttcttcaacggcaactacaaggtggacagccccaagaacttcaacatcgcaggcacggtggtcaagtacaggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcgtcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 104780 - DNA, 3725 bp, Homo sapiens
  Payload ID: 578
  Gene Symbol: ADAMTSL2
  Gene Name: ADAMTS-like 2
  Uniprot ID: Q86TH1
  ENST ID: ENST00000393060
  CDS Start-End: 216-3071
cgccgtctgccctccgcagcgctcgcccctttctctgggaggacaacctgctgacccgaagccagggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagacgaagctggctactacttcttcaacggcaactacaaggtggacagccccaagaacttcaacatcgcaggcacggtggtcaagtacaggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcgtcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggc

SEQ ID NO: 104781 - DNA, 4270 bp, Homo sapiens
  Payload ID: 578
  Gene Symbol: ADAMTSL2
  Gene Name: ADAMTS-like 2
  ENST ID: ENST00000393061
  CDS Start-End: 433-3615
acgggacacctcatacatcccagaccccattctcaggagccccagggacagggcccgctctggaggcagaagccggacaggcggggctggggctttgccaccgccagcctccccggtaacctcaggccagcggctgctccgtctggacacccgacatgtggcccccagttctggacccgggaagaaggcctccctgctcgccgctcctgggccgccgccgccggcagcagccaacaggcagctgggccggcctggccgggctccagaggcgcagagcgggttaaagtgtgcgccaggccggccggcgcgggcgggggagcggcctggtgggaagtgtgagtgttcctccccgtctgcctgacagctataaaggcggccgccggcgcagagccgccactgggctgcgcccctcccgggaaccccctctcttggatgctctttgaagtgggagagggaggcggcgcgggggaggaggggaaggggagagggaggccgggccgcagcctctgcactcacgccgcccccgcacgcacagcgcacctggcgccgtctgccctccgcagcgctcgcccctttctctgggaggacaacctgctgacccgaagccagggtctgccagacaaccacgaccaactagtcccagataaccttgaggcctgggcactggctgggccccgagggctcttcccaaagcgtaccctggtcatctggaagaggatcggagctggcctggtggtgacagtggccttgcttcctaggatggatggcagatggcaatgttcctgctgggcctggttcctgctggttctggcagttgtagctggggacacagtgtcaaccgggtccacggacaacagcccaacatccaatagcctggaggggggcaccgacgccacggccttctggtggggggagtggaccaagtggacggcgtgttcccgcagttgcgggggtggggtgacatcccaggagcggcactgcctgcagcagaggaggaagtccgtcccgggccccgggaacaggacctgcacgggcacgtccaagcggtaccagctctgcagagtgcaggagtgtccgccggacgggaggagcttccgcgaggagcagtgcgtctccttcaactcccacgtgtacaacgggcggacgcaccagtggaagcctctgtacccggatgactatgtccacatctccagcaaaccgtgtgacctgcactgtaccaccgtggacggccagcggcagctcatggtccccgcccgcgacggcacatcctgcaagctcactgacctgcgaggggtttgcgtgtctggaaaatgtgagcccatcggctgtgacggggtgcttttctccacccacacactggacaagtgtggcatctgccagggggacggtagcagctgcacccacgtgacgggcaactatcgcaaggggaatgcccaccttggttactctctggtgacccacatcccggctggtgcccgagacatccagattgtagagaggaagaagtccgctgacgtgctagctcttgcagacgaagctggctactacttcttcaacggcaactacaaggtggacagccccaagaacttcaacatcgcaggcacggtggtcaagtacaggcggcccatggatgtctatgagaccggaatcgagtacatcgtggcacaggggcccaccaaccagggcctgaatgtcatggtgtggaaccagaacggcaaaagcccctccatcaccttcgagtacacgctgctgcagccgccacacgagagccgcccccagcccatctactatggcttctccgagagcgctgagagccagggcctggacggggccgggctgatgggcttcgtcccgcacaacggctccctctacggccaggcctcctcagagcggctgggcctggacaaccggctgttcggccacccgggcctggacatggagctgggccccagccagggccaggagaccaacgaggtgtgcgagcaggccggcggcggggcctgcgaggggccccccaggggcaagggcttccgagaccgcaacgtcacggggactcctctcaccggggacaaggatgacgaagaggttgacacccacttcgcctcccaggagttcttctcggctaacgccatctctgaccagctgctgggcgcaggctctgacttgaaggacttcaccctcaatgagactgtgaacagcatctttgcacagggcgccccaaggagctccctggccgagagcttcttcgtggattatgaggagaacgagggggctggcccttacctgctcaacgggtcctacctggagctgagcagcgacagggttgccaacagctcctccgaggccccattccccaacgttagcaccagcctgctcacctcggccgggaacaggactcacaaggccaggaccaggcccaaggcgcgcaagcaaggcgtgagtcccgcggacatgtaccggtggaagctctcgtcccacgagccctgcagtgccacctgcaccacaggggtcatgtctgcgtacgccatgtgtgtccgctatgatggcgtcgaggtggatgacagctactgtgacgccctgacccgtcccgagcctgtccacgagttctgcgctgggagggagtgccagcccaggtgggagacgagcagctggagcgagtgttcgcgcacctgcggagagggctaccagttccgcgtcgtgcgctgctggaagatgctctcgcccggcttcgacagctccgtgtacagcgacctgtgcgaggcagccgaggccgtgcggcccgaggaacgcaagacctgccggaaccccgcctgcgggccccagtgggagatgtcggagtggtccgagtgcactgccaagtgtggggagcgcagtgtggtgaccagggacatccgctgctcggaggatgagaagctgtgtgaccccaacaccaggcctgtaggggagaagaactgcacgggcccgccctgtgaccggcagtggaccgtctccgactggggaccgtgcagtggaagctgcgggcaaggccgcaccatcaggcacgtgtactgcaagaccagcgacggacgggtagtacctgagtcccagtgccagatggagaccaagcctctggccatccacccctgtggggacaaaaactgtcccgcccactggctggcccaggactgggagcggtgcaacaccacctgcgggcgcggggtcaagaagcggctggtgctctgcatggagctggccaacgggaagccgcagacgcgcagtggccccgagtgcgggctcgccaagaagcctcccgaggagagcacgtgtttcgagaggccctgcttcaagtggtacaccagcccctggtcagagtgcaccaagacctgcggggtgggcgtgaggatgcgagacgtcaagtgctaccaggggaccgacatcgtccgtggttgcgatccgttggtgaagcccgttggcagacaggcctgtgatctgcagccctgccccacggagcccccagatgacagctgccaggaccagccaggcaccaactgtgccctggccatcaaagtgaacctctgcgggcactggtactacagcaaggcgtgctgccgctcctgcaggcccccccactcctaggcccggcagctgcagccccttccagatgaagaccaagcgcccctcctggggctgctgcagcttctggggcctccacagacccccctcctgcggggcacgctggcctaagagacgtggcactgagcctcggctgtcgagaggggacttcccacggcccgtggacctttgtgctcctggggcagagcctccggcacccagtggcctcccccagacagagccacccctgccgtgggaacctgtccgtgttcctgcgtggatcctgtgtttgtggctcccactccccagccccccagcagcccccagccgaggggcccagggcccacagccagcggtggaggtgtcttgctccgggcccgtagcccacgccctctctgggtggcagggccttctgaaggaaacttgcaggcgagcccaacgtggtggggggccttcctccctcagaggccatggggtgagaggggctcaggcagccaaggaggcccaggcgtgctccctcttatggagcccctcccatggagctctcttcccgccgcactttctaccccgggcagaggcgcttgcccacgggacgtttggggatggacctcggcccccgcccctgcagtcagcgtcagtgctcatctacgttaataaagtggtcctatttatggcggca

SEQ ID NO: 104782 - DNA, 7336 bp, Homo sapiens
  Payload ID: 579
  Gene Symbol: ADAMTSL3
  Gene Name: ADAMTS-like 3
  Uniprot ID: P82987
  ENST ID: ENST00000286744
  CDS Start-End: 225-5300
cccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttataaa

SEQ ID NO: 104783 - DNA, 6873 bp, Homo sapiens
  Payload ID: 579
  Gene Symbol: ADAMTSL3
  Gene Name: ADAMTS-like 3
  Uniprot ID: P82987
  ENST ID: ENST00000567476
  CDS Start-End: 223-5271
cagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagtacgtacacctcccagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattggg

SEQ ID NO: 104784 - DNA, 4250 bp, Homo sapiens
  Payload ID: 580
  Gene Symbol: ADAMTSL4
  Gene Name: ADAMTS-like 4
  Uniprot ID: Q6UY14
  ENST ID: ENST00000271643
  CDS Start-End: 290-3514
ggagttgcggccgaggcggccgtgaccggagcgcggctcaggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatg

SEQ ID NO: 104785 - DNA, 4167 bp, Homo sapiens
  Payload ID: 580
  Gene Symbol: ADAMTSL4
  Gene Name: ADAMTS-like 4
  Uniprot ID: Q6UY14
  ENST ID: ENST00000369038
  CDS Start-End: 202-3426
gaggatcctaaagggatggaccagtttcaccccctcctccatattctctgagctgtcctcccagccccaagctctctggacactggagaggtaaccaccaggcttctgtccctgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgagaaa

SEQ ID NO: 104786 - DNA, 4319 bp, Homo sapiens
  Payload ID: 580
  Gene Symbol: ADAMTSL4
  Gene Name: ADAMTS-like 4
  Uniprot ID: Q6UY14
  ENST ID: ENST00000369039
  CDS Start-End: 290-3583
ggagttgcggccgaggcggccgtgaccggagcgcggctcaggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagcccctctgcttcccctgcgccatgccttctttcttctccctggggctgggtcaggagacagcacaggtgtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatg

SEQ ID NO: 104787 - DNA, 2908 bp, Homo sapiens
  Payload ID: 580
  Gene Symbol: ADAMTSL4
  Gene Name: ADAMTS-like 4
  Uniprot ID: Q6UY14
  ENST ID: ENST00000369041
  CDS Start-End: 251-2884
aggggccccagtggccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaaggtgagcccggaacccccagccatatcctgcatcctgggtaaccacgcccaggacacctcagcctttccagcatagctcaataaacttgtattgatcaag

SEQ ID NO: 104788 - DNA, 2783 bp, Homo sapiens
  Payload ID: 580
  Gene Symbol: ADAMTSL4
  Gene Name: ADAMTS-like 4
  ENST ID: ENST00000622417
  CDS Start-End: 209-1516
gcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccaatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgag

SEQ ID NO: 104789 - DNA, 2857 bp, Homo sapiens
  Payload ID: 581
  Gene Symbol: ADAMTSL5
  Gene Name: ADAMTS-like 5
  ENST ID: ENST00000330475
  CDS Start-End: 445-1860
cgctcgcgtccgccgggcagtcccctgccgcagatccgcgcccgccgcgcgagggcgcccggggccgccgcccctcctgacccgggcctgggcgcgcctgcggaggccgcggtgggagggaccgtcccaggctccccaccccgcccagcaccttgggccccgccgcttccgctcgccctggggccgctcagggagccgggacgcgctgcctgggctccgcgcagccgatgacattctgagttcttcctctccataccgggctccacgtctcctgtcttctttacctgatccacaggacccctcaactttcctgtaagggaggctctattaccccgtttttcagagacgagaggtagggctcagagaggtttagttactttccaagatcacacagccagtcagggcagagccgggacacaaccctgtgtctctggcggtggctctatggactcggcccctctgttccccaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccggtgccttcgctgggtactggaacgtgaccctgatccccgagggcgccagacacatccgcgtggaacacaggagccgcaaccacctggcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccagacccctgcccaccctgccctgacacccgcggccgcgcccaccgactactccactattgcggcagtgactttgtgttccaggcccgagtgctgggccaccaccaccaggcccaggagacccgctatgaggtgcgcatccagctcgtctacaagaaccgctcgccactgcgggcacgcgagtacgtgtgggcgccaggccactgcccctgcccgatgctggcaccccaccgggactacctgatggctgtccagcgtcttgtcagccccgacggcacacaggaccagctgctgctgccccacgccggctacgcccggccctggagccctgcggaggacagccgcatacgcctgactgcccggcgctgtcctggctgagcccctgcaggagccccggccacacacagcaagaaagatacatctgaccagcctcaacgtcaacgtatttcccctctcaccctggcttccaggcagctctgaaatacgtcccacctgtgcagctatgtgactccctcccacacacgcttaagacacctctgcatgcagtcaaagccactgtcacaagccggcaggcactggtgaggaggcactaaggagactctgacttttatttcgcctctctccttggctgccaggaagctcatagctatttatactcagaaagtttaacgctgctttctttctctttgcgcgcgtcacacttgcttggagacactgtcatgaacgagcatgacaccctgctgccctgggtacccagaagatcatctgtttacttcccagacactgtgctgtctctgctctctgctactcacacacaccctcatgtgtgaagggcagagacactgtcacaaacaggcatgccccttagaagacatgcctaaccaggcactgtaacgtaccaacgtaccaatttccccttttcccctggctaccaggaaactcggagacaatcttttcagcctcagcatttctggctggatttccacccatcaacacgtgcttgctcctcctttttttttttttctgaggtagacccttgctctgtcacctaggctgaagtgcggtggtgcaatcatggctcactgcagcctcaaattcctgggctcaagcgatcctcccacctcagcctccacagcagctggaactccaggtgtgaatcaccatgcccggctaacttttaaattttttgtagagatggggtcttgctacgttgcccacactgctctccaactactggcctcaaacgatcctcctgcctcggcctcccaaagcactggaatttcaggcatgcactatcgtactggctgttcaccccccttttattcctctttaatttttacaagcactttttaaaaaaaaattttactttaagttc

SEQ ID NO: 104790 - DNA, 1533 bp, Homo sapiens
  Payload ID: 581
  Gene Symbol: ADAMTSL5
  Gene Name: ADAMTS-like 5
  ENST ID: ENST00000395467
  CDS Start-End: 1138-1533
cgctcgcgtccgccgggcagtcccctgccgcagatccgcgcccgccgcgcgagggcgcccggggccgccgcccctcctgacccgggcctgggcgcgcctgcggaggccgcggtgggagggaccgtcccaggctccccaccccgcccagcaccttgggccccgccgcttccgctcgccctggggccgctcagggagccgggacgcgctgcctgggctccgcgcagccgatgacattctgagttcttcctctccataccgggctccacgtctcctgtcttctttacctgatccacaggacccctcaactttcctgtaagggaggctctattaccccgtttttcagagacgagaggtagggctcagagaggtttagttactttccaagatcacacagccagtcagggcagagccgggacacaaccctgtgtctctggcggtggctctatggactcggcccctctgttccccaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccggtgccttcgctgggtactggaacgtgaccctgatccccgagggcgccagacacatccgcgtggaacacaggagccgcaaccacctggcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccaggcccgagtgctgggccaccaccaccaggcccaggagacccgctatga

SEQ ID NO: 104791 - DNA, 406 bp, Homo sapiens
  Payload ID: 581
  Gene Symbol: ADAMTSL5
  Gene Name: ADAMTS-like 5
  ENST ID: ENST00000590090
  CDS Start-End: 1-406
agacacatccgcgtggaacacaggagccgcaaccacctgggtatcctaggatcactgatggggggcgatgggcgctacgtgcttaatgggcactgggtggtcagcccaccagggacctacgaggcggccggcacgcatgtggtctacacccgagacacagggccccaggagacattgcaagcagccgggcccacctcccatgacctgctcctacaggtcctcctgcaggagcccaaccctggcatcgagtttgagttctggctccctcgggagcgctacagccccttccaggctcgtgtgcaggccctgggctggcccctgaggcagcctcagccccggggggtggagcctcagccccccgcagcccctgctgtcacccctgcacagaccccaacgctggccccag

SEQ ID NO: 104792 - DNA, 573 bp, Homo sapiens
  Payload ID: 581
  Gene Symbol: ADAMTSL5
  Gene Name: ADAMTS-like 5
  ENST ID: ENST00000590562
  CDS Start-End: 150-573
gctcgccctggggccgctcagggagccgggacgcgctgcctgggctccgcgcagccgggacccaactcctgatccagcccctgccggccgcaccttccgcagggtgtcacagaatcatggactgagtccacttggcccccactgcacagatggggaaactgaggcctgggagagtggagtggctggcctcaggccacacggaaaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctg

SEQ ID NO: 104793 - DNA, 735 bp, Homo sapiens
  Payload ID: 581
  Gene Symbol: ADAMTSL5
  Gene Name: ADAMTS-like 5
  ENST ID: ENST00000586272
  CDS Start-End: 105-735
gctcgccctggggccgctcagggagccgggacgcgctgcctgggctccgcgcagccgggtgtcacagaatcatggactgagtccacttggcccccactgcacagatggggaaactgaggcctgggagagtggagtggctggcctcaggccacacggaaaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatggggcgcccaaccagtgcgacctcaactgcctggctgaggggcacgccttctaccacagcttcggccgcgtcctggacggcaccgcctgcagcccgggtgcccagggggtctgcgtggctggccgctgccttagcgccggctgtgatgggttgttgggctcgggtgccctcgaggaccgctgtggccgctgcggaggcgccaacgactcgtgccttttcgtgcagcgcgtgtttcgtgacgccg

SEQ ID NO: 104794 - DNA, 574 bp, Homo sapiens
  Payload ID: 581
  Gene Symbol: ADAMTSL5
  Gene Name: ADAMTS-like 5
  ENST ID: ENST00000585804
  CDS Start-End: 184-574
acggggccgagcctctccccagtgcgctggggccctgcgctgggggtgaccgggacctgggtcggggaacccccggatgggagcccaggcgcgccagggtccccatccacgagcaggtcgaccccccgcgagagggggtgtcacagaatcatggactgagtccacttggcccccactgcacagatggggaaactgaggcctgggagagtggagtggctggcctcaggccacacggaaaggccccacctcttccagaacctcctgctcttcctgtgggccctgctgaactgtggtttgggggtcagtgctcagggtccgggcgagtggaccccgtgggtgtcctggacccgctgctccagctcctgcgggcgtggcgtctctgtgcgcagccggcgctgcctccggcttcctggggaagaaccgtgctggggagactcccatgagtaccgcctctgccagttgccagactgccccccaggggctgtgcccttccgagacctacagtgtgccctgtacaatggccgccctgtcctgggcacccagaagacctaccagtgggtgcccttccatgggg

SEQ ID NO: 104795 - DNA, 6058 bp, Homo sapiens
  Payload ID: 582
  Gene Symbol: APPL1
  Gene Name: adaptor protein, phosphotyrosine interaction, PH domain and leucine zipper containing 1
  Uniprot ID: Q9UKG1
  ENST ID: ENST00000288266
  CDS Start-End: 148-2277
gctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgtacagtgttttttaatg

SEQ ID NO: 104796 - DNA, 516 bp, Homo sapiens
  Payload ID: 582
  Gene Symbol: APPL1
  Gene Name: adaptor protein, phosphotyrosine interaction, PH domain and leucine zipper containing 1
  ENST ID: ENST00000444459
  CDS Start-End: 116-516
ctccgccacgatgccggggatcgacaagctgcccatcgaggagacgctggaggacagcccgcagaatagagtccaagaagcagagcagcaaagaatatgaagacttttaaagctcatgacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatc

SEQ ID NO: 104797 - DNA, 396 bp, Homo sapiens
  Payload ID: 582
  Gene Symbol: APPL1
  Gene Name: adaptor protein, phosphotyrosine interaction, PH domain and leucine zipper containing 1
  ENST ID: ENST00000495803
  CDS Start-End: 54-396
ggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcttagctcttgtcatgcagtgctttcaactcaacttgctgatgccatgatgttccccattacccagtttaaagaaagagatctgaaagaaatactaacattaaaggaagtatttcagattgcaagtaatg

SEQ ID NO: 104798 - DNA, 3239 bp, Homo sapiens
  Payload ID: 583
  Gene Symbol: APPL2
  Gene Name: adaptor protein, phosphotyrosine interaction, PH domain and leucine zipper containing 2
  Uniprot ID: Q8NEU8
  ENST ID: ENST00000258530
  CDS Start-End: 227-2221
tttccctgccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttctttc

SEQ ID NO: 104799 - DNA, 2680 bp, Homo sapiens
  Payload ID: 583
  Gene Symbol: APPL2
  Gene Name: adaptor protein, phosphotyrosine interaction, PH domain and leucine zipper containing 2
  Uniprot ID: Q8NEU8
  ENST ID: ENST00000539978
  CDS Start-End: 436-2301
tctattcatggactcctttttagtttgcagtgctgcacgatgcattgtaaaactagtctgtgtgcatacacatgcgttatttctgcttacctctcatatgtgggaagctgaacattttagggattaagaaatctgcctccattgttgtttagaagcctctgctccttgcctggcactactggctgttgggaatgtgaagataaataagagtgactacccttgactggttcacagtttgttccagagacagataatgaggcaacagttccagtacagtgtgaatcctgctgcgataggaacacaaatgcagctttgagctcctgcagcttgtacttcttcaggggcttattctcttgtcctactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacac

SEQ ID NO: 104800 - DNA, 564 bp, Homo sapiens
  Payload ID: 583
  Gene Symbol: APPL2
  Gene Name: adaptor protein, phosphotyrosine interaction, PH domain and leucine zipper containing 2
  ENST ID: ENST00000553109
  CDS Start-End: 1-564
gatattgtgcttcctgctacagaattccttgatcagaacagagggagcaggcgtaccaacccttttggtgaaactgaggatgaatcatttccagaagcagaagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacat

SEQ ID NO: 104801 - DNA, 2190 bp, Homo sapiens
  Payload ID: 583
  Gene Symbol: APPL2
  Gene Name: adaptor protein, phosphotyrosine interaction, PH domain and leucine zipper containing 2
  Uniprot ID: Q8NEU8
  ENST ID: ENST00000551662
  CDS Start-End: 72-2084
agtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgatgtctgtttatttttagagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgac

SEQ ID NO: 104802 - DNA, 493 bp, Homo sapiens
  Payload ID: 583
  Gene Symbol: APPL2
  Gene Name: adaptor protein, phosphotyrosine interaction, PH domain and leucine zipper containing 2
  ENST ID: ENST00000549056
  CDS Start-End: 309-493
gttgcagtgagccgagatcgcaccattgcactccagcctgggcaacaagagcgaaactccatctcaaaaaaagaaagaaagaaagaaaaagaaacaaggaaatcgtagtaccataagaggaaagaatgacacactcctacactcctgcaagacatccaagattacaaaaaaccagactgctggttcctgctgggatgatcacactacagctgtgctagatgaccacaccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaa

SEQ ID NO: 104803 - DNA, 684 bp, Homo sapiens
  Payload ID: 583
  Gene Symbol: APPL2
  Gene Name: adaptor protein, phosphotyrosine interaction, PH domain and leucine zipper containing 2
  ENST ID: ENST00000546731
  CDS Start-End: 152-475
aaatacatttaagagagagaagaaaaattcctattaagaacttttaacactggaattacctgagtttcacttacctggaatattttttgtgtggcataaattggcaacagaggtcaggacagttggacgcaaatgccccgggccctatgtgatgagtctcctgcagccaggtcctgtgttcccaagtgggaacagtgagaacagtgacctcactgtactcccaaatcacatttgttctaaaattttatccttctctacttttgccaatcactacttttcttgtcttttgcagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttagg

SEQ ID NO: 104804 - DNA, 547 bp, Homo sapiens
  Payload ID: 583
  Gene Symbol: APPL2
  Gene Name: adaptor protein, phosphotyrosine interaction, PH domain and leucine zipper containing 2
  ENST ID: ENST00000549974
  CDS Start-End: 2-121
aatggttctacctatcatacaattccgagaaaaggatctcacagaagtaagcactttaaaggatctatttggactcgctagcaatgcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaagcattcaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaagtgagaacgccaccgtctgcctctttttctgaaatccgttt

SEQ ID NO: 104805 - DNA, 3196 bp, Homo sapiens
  Payload ID: 583
  Gene Symbol: APPL2
  Gene Name: adaptor protein, phosphotyrosine interaction, PH domain and leucine zipper containing 2
  ENST ID: ENST00000547439
  CDS Start-End: 192-899
cggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgttgcaggacagcccccagactcgctctttactgagcgtgtttgaagaagatgctggcaccctcacagactataccaaccagctgctccaggcaatgcagcgcgtctatggagcccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcctcccttcagtactactgtgccctcaacgcgctgcagtacagaaagcaaatggccatgatggagcccatgataggctttgcccatggacagattaacttttttaagaagggagcagagatgttttccaaacgtatggacagctttttatcctccgttgcagacatggttcaaaggtagaactggaagccgaggcggaaaagatgcgggtgtcccagcaagaattactttctgttgatgaatctgtttacactccagactctgatgtggccgcaccacagatcaacaggaacctcatccagaaggctggttaccttaatcttagaaacaaaacagggctggtcaccaccacctgggagaggctttatttcttcacccaaggcgggaatctcatgtgtcagcccaggggagccgtggctggaggtttgatccaggacctggacaactgctcagtgatggccgtggattgcgaagaccggcgctactgcttccagatcaccacgcccaatggaaaatcgggaataatcctccaggctgagagcagaaaggaaaatgaagagtggatatgtgcaataaacaacatctccagacagatctacctgaccgacaaccctgaggcagtcgcgatcaagttgaatcagaccgctctgcaagcagtgactcccattacaagttttggaaaaaaacaagaaagctcatgccccagccagaacctgaaaaattcagagatggaaaatgaaaatgacaagattgttcccaaagcaacagccagtctacctgaagcagaggagctgatcgcgcctggaacgccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtttttgggatcaatggcagttaaaacagacagcactactgaagtgatttatgaagcgatgagacaagtattggctgctcgggctattcataacatcttccgcatgacagaatcccatctgatggtcaccagtcaatctttgaggttgatagatccacagactcaagtatcaagggccaattttgaacttaccagtgtcacacaatttgctgctcatcaagaaaacaagagactggttggttttgtcatccgtgttcctgaatccactggagaagaatctctgagtacatacatttttgaaagcaactcagaaggcgaaaagatatgttatgctattaatttgggaaaagaaattattgaggttcagaaggatccagaagcactggctcaattaatgctgtccataccactaaccaatgacggaaaatatgtactgttaaacgatcaaccagatgacgatgatggaaatccaaacgaacatagaggcgcagaatccgaagcataactcacttgcgcctgtgggggaagagcaaacaggaaggagagctacctcctaagggttttaacgtctctgacatacaggcacactgacctgatttccgaaggctgacaatcgtttgtggaatgtaatcttgatgccttgatactgagacttgggagggaaactaagaaatggttgacagcgttcccacccatctacaatgttattttaggtgctttgtggtaagtcttttttcttagattgcgctaaaatttcttagattgttcagcgctcagaacaaaagtttgaaaaatgcattgttcatatgaatgtcatctcttttcagtttccagtatcctttttaaaaaatggcaaaagcctagatttacaatttgatgaacactaaatatttcttattaatataatctatttttgtattttacttaatgagctttaagtgcctgtcgttctgaaaattgtgtatttataattcagcttatctcataattggacctaatagcatttctttgtgcagttaggtgatgagcactgctttgaggcccaagcactagtagagatgcgcgatacaggtctagtttcggtaactgttccagacatcaagcaataaaaaaatgaataccacaaaagatgtttgattttacagtggagccttactgaaccagcattcagaagtttaaggtcctcctaggtatgagtatttttagtagtggatcactgtggacagggtgcagctctaccagttcctgtttcttctgagccagaccctcttcagggaagggaccaattaattttaaaactcacttgaagcacagctggtcatggggcttggtataaagttcctatttccaccctgatacttccaattcctggaaccccagcccactcccccatccctcctccctatcaaactagtataatgattttgaatcggtacagtgtgtttaactgtaactaagttcaacagactattattatctttgtaataaattaacctagcaataaaaaatattctgtttcttt

SEQ ID NO: 104806 - DNA, 514 bp, Homo sapiens
  Payload ID: 583
  Gene Symbol: APPL2
  Gene Name: adaptor protein, phosphotyrosine interaction, PH domain and leucine zipper containing 2
  ENST ID: ENST00000553097
  CDS Start-End: 82-514
agagccggggagtgctctcggccgccgcgtctcctgccctctgtccttccaacccagccctcggctgagccgcgccgcaccatgcccgccgtggacaagctcctgctagaggaggcgttgcaggacagcccccagaatgagatgtgcctggccacacaacagctttctaagcaactgctggcatatgaaaaacagaactttgctcttggcaaaggtgatgaagaagtaatttcaacactccactatttttccaaagtggtggatgagcttaatcttctccatacagagctggctaaacagttggcagacacaatggttctacctatcatacaattccgagaaaaggatctcacagaagtaagcactttaaaggatctatttggactcgctagcaatgagcatgacctctcaatggcaaaatacagcaggctgcctaagaaaaaggagaatgagaaggtgaagaccgaagtcggaaaagaggtggccgcggcccggcggaagcagcacctctcct

SEQ ID NO: 104807 - DNA, 2902 bp, Homo sapiens
  Payload ID: 584
  Gene Symbol: AP1AR
  Gene Name: adaptor-related protein complex 1 associated regulatory protein
  Uniprot ID: Q63HQ0
  ENST ID: ENST00000274000
  CDS Start-End: 356-1264
agggtgctcggctcgcggggactggcctccttcggcagctggaggcggtcactcacgctgggctaggagctgaggcgagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagttagccttacaagaagagaagttaagactagaagaagaagctttatacgctgcacagcgtgaagcagccagggcagcaaagcagcgaaagctcttggagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaatcatgtggccctttcaatatttgaactgctaagcaatgacatctgtagttttatctccttttttatgtcatagaaattaatatgatactttaaatatgtaaatataatacattaggtaatgctattatttatatctgtcttaacataatttaagttgtagctgtgtcttggaaatatttttaaggtaatctatattcacattgcctgtgttaatgctttttaaagtttgtatacatcagatgtatatttttggtttggcataagctacgattgtaatttttcttggctttttgttcataaagaattttttgaaggaatggtaacaaatggtaatttacaaatggttgtgaataaacacatttttacactt

SEQ ID NO: 104808 - DNA, 2337 bp, Homo sapiens
  Payload ID: 584
  Gene Symbol: AP1AR
  Gene Name: adaptor-related protein complex 1 associated regulatory protein
  Uniprot ID: Q63HQ0
  ENST ID: ENST00000309703
  CDS Start-End: 260-1069
cgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggagcggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagtttgagaatctagtagaaagtgatgaaggggagagcccaggaagcagtcataggcctcttactgaggaagaaattgttgacctaagagaaaggcattatgattccattgccgaaaaacaaaaagatcttgataagaaaattcaaaaagagcaagaaaggcagagaattgtgcagcaatatcatccttccaacaatggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgccactatattgactttaattgatatacagtattaagtttttaggtgccattatttttaaaaaattctatatttccaatgaacgatgttagattttacacagaacatattctctgcatgatttcagaaaagaaaatctaaaaaggtaatacgggtatttcaaataaaatcctttctggtatgaaaggctccattgattttattaagccttcctttaccttgtagtacaaggtgctttaatgggatagaactaagcatatcaatatctataactgcattttgtgctagacaattactgttcttttctctaaaatgtatatgtcaatttacaaggccagggatagaaaacactccataattgctttccttgattttgctgaggatttggtatgattttagtaagcaaactgttttttggtttttccttaatgtttttaattttttttcctcttgcaacaatgacggtgcatgttcttataaatataggaaggtccagatataaatagtaacctaaagttcttgctgtgcttaaaaaaaaaaa

SEQ ID NO: 104809 - DNA, 333 bp, Homo sapiens
  Payload ID: 584
  Gene Symbol: AP1AR
  Gene Name: adaptor-related protein complex 1 associated regulatory protein
  ENST ID: ENST00000512741
  CDS Start-End: 1-230
atggagaatatcaaagttcaggaccagaagatgacttcgaatcttgtttgagaaatatgaagtcacagtatgaagtttttcgaagtagtagactctcatcagatgctacagttttgacaccaaatacagaaagcagttgtgatttaatgaccaaaactaaatcaactagtggaaatgacgacagcacatccttagatctagagtgggaagatgaagaaggtattttataattcacaattttacctgaaaaatttaacgtaatctgtgttgatttatgtaaatctaccttggtctttatttaaatggaaataaattcaaggccttgaaaaatca

SEQ ID NO: 104810 - DNA, 3903 bp, Homo sapiens
  Payload ID: 585
  Gene Symbol: AP1B1
  Gene Name: adaptor-related protein complex 1, beta 1 subunit
  Uniprot ID: Q10567
  ENST ID: ENST00000317368
  CDS Start-End: 188-2947
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggc

SEQ ID NO: 104811 - DNA, 4176 bp, Homo sapiens
  Payload ID: 585
  Gene Symbol: AP1B1
  Gene Name: adaptor-related protein complex 1, beta 1 subunit
  Uniprot ID: Q10567
  ENST ID: ENST00000357586
  CDS Start-End: 188-3037
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatc

SEQ ID NO: 104812 - DNA, 3838 bp, Homo sapiens
  Payload ID: 585
  Gene Symbol: AP1B1
  Gene Name: adaptor-related protein complex 1, beta 1 subunit
  Uniprot ID: Q10567
  ENST ID: ENST00000405198
  CDS Start-End: 33-2882
tgcagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggacttagagctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggc

SEQ ID NO: 104813 - DNA, 2935 bp, Homo sapiens
  Payload ID: 585
  Gene Symbol: AP1B1
  Gene Name: adaptor-related protein complex 1, beta 1 subunit
  Uniprot ID: Q10567
  ENST ID: ENST00000402502
  CDS Start-End: 33-2852
tgcagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcagg

SEQ ID NO: 104814 - DNA, 2838 bp, Homo sapiens
  Payload ID: 585
  Gene Symbol: AP1B1
  Gene Name: adaptor-related protein complex 1, beta 1 subunit
  Uniprot ID: Q10567
  ENST ID: ENST00000415447
  CDS Start-End: 19-2838
tacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactga

SEQ ID NO: 104815 - DNA, 519 bp, Homo sapiens
  Payload ID: 585
  Gene Symbol: AP1B1
  Gene Name: adaptor-related protein complex 1, beta 1 subunit
  ENST ID: ENST00000415756
  CDS Start-End: 1-519
ggacatcatgatccgcctggcctctcaggccaacatcgcccaggcacctgccagctctctcccttgggccttctacctggagcaggaggcagaatcccattctcctagggagtctgtgtatattcactgcccaggagtgttccagcagattgccccatcaggtgccccagccccatcttttctgtttgggccacaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaa

SEQ ID NO: 104816 - DNA, 1908 bp, Homo sapiens
  Payload ID: 585
  Gene Symbol: AP1B1
  Gene Name: adaptor-related protein complex 1, beta 1 subunit
  ENST ID: ENST00000421126
  CDS Start-End: 175-1908
cacccatctgtcaccagcaggttgcgtcctgggaatttagggccctctgatgttgtattgggcctgcaggggaggggacaggctctgacggctttttcttctggagaggcaagaaattccgagcagctctcacattagttatctaagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctccc

SEQ ID NO: 104817 - DNA, 4146 bp, Homo sapiens
  Payload ID: 585
  Gene Symbol: AP1B1
  Gene Name: adaptor-related protein complex 1, beta 1 subunit
  Uniprot ID: Q10567
  ENST ID: ENST00000432560
  CDS Start-End: 188-3007
cccgcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcgccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatc

SEQ ID NO: 104818 - DNA, 6969 bp, Homo sapiens
  Payload ID: 586
  Gene Symbol: AP1G1
  Gene Name: adaptor-related protein complex 1, gamma 1 subunit
  Uniprot ID: O43747
  ENST ID: ENST00000299980
  CDS Start-End: 443-2911
aagcggaaccaatgtccgtccgctacggggtaggccggatctttctcgctcagactcatcgcagcggtgactcggcagcagcgtctcgcgtcatcagtgacagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaa

SEQ ID NO: 104819 - DNA, 3593 bp, Homo sapiens
  Payload ID: 586
  Gene Symbol: AP1G1
  Gene Name: adaptor-related protein complex 1, gamma 1 subunit
  Uniprot ID: O43747
  ENST ID: ENST00000393512
  CDS Start-End: 443-2920
aagcggaaccaatgtccgtccgctacggggtaggccggatctttctcgctcagactcatcgcagcggtgactcggcagcagcgtctcgcgtcatcagtgacagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactgg

SEQ ID NO: 104820 - DNA, 1166 bp, Homo sapiens
  Payload ID: 586
  Gene Symbol: AP1G1
  Gene Name: adaptor-related protein complex 1, gamma 1 subunit
  ENST ID: ENST00000450149
  CDS Start-End: 74-604
atgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggaaatgatttataaacaaacaaatgttactggatatatcctaggtggcataccaaattcctaagttatctgattctaaacagtattacagcaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttg

SEQ ID NO: 104821 - DNA, 2723 bp, Homo sapiens
  Payload ID: 586
  Gene Symbol: AP1G1
  Gene Name: adaptor-related protein complex 1, gamma 1 subunit
  ENST ID: ENST00000564155
  CDS Start-End: 805-1548
attttggccagactggtctcgaactcctgaccttgtaatctggccaaggttttggtttattatattttgacaagtcttaataggaataaaatcatgaatgttttggtgattaaatcttttaattctcctctttgcttttttgaataaagtagattctcaggtcactttcccacccaagcatatttaaggccaacgtagttcttgtagtctttctgcttcacttttaaatgtgaagtcttataaaaaatggtattgaattacttttaaaattctgaactggaagaatttggggtcaacattttgaggctctgacccttttatagattaaaaattatttaaaaattatcaaagaagagaatgaacagtacaaatttcttttgtggcaaagtaatagttggtacttttgtctagcaaagtttagggagtggcatatatatatgtgttttttccacaccatcattgttgctgaatggggatggcatatttaacagacaaaaatctagtgttacaatgagaatagtataatgcgaatgtcagataaatggatgaaagtaaagtgttttgtttttgaaaaactatataaattaagaaaaaatgagtatttcagtattttaaccagaaaattctggcttattaaacattatctctgcttatttgtgaattttcttttgggtattttatttcgtttgtcattttatctatagccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaag

SEQ ID NO: 104822 - DNA, 4554 bp, Homo sapiens
  Payload ID: 586
  Gene Symbol: AP1G1
  Gene Name: adaptor-related protein complex 1, gamma 1 subunit
  Uniprot ID: O43747
  ENST ID: ENST00000569748
  CDS Start-End: 911-3379
gacagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgctcctggccctgcggacgtcagcgtctaataattctcccggtcttcctgattgcctgaaagagtcgggacggttcggttgattgtgtttcccggttaggactcggtgtaggagatccatcgaaccactcgctcagggtaatgtttatgaagcagattatgtttatgaagcagattaaatggcttttgggaggcaagagctgtcaaatgttttctcatatgtggattccctccctgtgctgaatacttagctttttggtgcttactgacacttgtgtggtatttttttttctcccctattatatatccctgagcacggaaatctgtccatggagaaaaatattaatctgaggaactgtcaaacactgaacacctatgtaatgctcactcatttaaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaag

SEQ ID NO: 104823 - DNA, 882 bp, Homo sapiens
  Payload ID: 586
  Gene Symbol: AP1G1
  Gene Name: adaptor-related protein complex 1, gamma 1 subunit
  ENST ID: ENST00000563104
  CDS Start-End: 449-882
actgctgccgccgcccccggagctgctggtttcattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgctcctggccctgcggacgtcagcgtctaataattctcccggtcttcctgattgcctgaaagagtcgggacggttcggttgattgtgtttcccggttaggactcggtgtaggagatccatcgaaccactcgctcaggaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagct

SEQ ID NO: 104824 - DNA, 561 bp, Homo sapiens
  Payload ID: 586
  Gene Symbol: AP1G1
  Gene Name: adaptor-related protein complex 1, gamma 1 subunit
  ENST ID: ENST00000569975
  CDS Start-End: 402-561
actgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgctcctggccctgcggacgtcagcgtctaataattctcccggtcttcctgattgcctgaaagagtcgggacggttcggttgattgtgtttcccggttaggactcggtgtaggagatccatcgaaccactcgctcaggcacggaaatctgtccatggagaaaaatattaatctgagaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattac

SEQ ID NO: 104825 - DNA, 562 bp, Homo sapiens
  Payload ID: 586
  Gene Symbol: AP1G1
  Gene Name: adaptor-related protein complex 1, gamma 1 subunit
  ENST ID: ENST00000566179
  CDS Start-End: 1-177
agtgaagctatgaatgatatattagcacaggttgccactaatactgagactagtaaaaatgtaggaaatgctattctttatgaaacggttttgactatcatggatattaagtcagagagtggattgcgaatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaa

SEQ ID NO: 104826 - DNA, 1724 bp, Homo sapiens
  Payload ID: 586
  Gene Symbol: AP1G1
  Gene Name: adaptor-related protein complex 1, gamma 1 subunit
  ENST ID: ENST00000568327
  CDS Start-End: 249-959
ggatgttcggttcctgctgccactgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaaggtagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggcca

SEQ ID NO: 104827 - DNA, 814 bp, Homo sapiens
  Payload ID: 586
  Gene Symbol: AP1G1
  Gene Name: adaptor-related protein complex 1, gamma 1 subunit
  ENST ID: ENST00000570017
  CDS Start-End: 735-814
gacagccccgatccttgctacgtttgcgtcgctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgctcctggccctgcggacgtcagcgtctaataattctcccggtcttcctgattgcctgaaagagtcgggacggttcggttgattgtgtttcccggttaggactcggtgtaggagatccatcgaaccactcgctcaggcacggaaatctgtccatggagaaaaatattaatctgaggaactgtcaaacactgaacacctatgtaatgctcactcatttaaggatgccagcccccatcagattgcgggagctgatccggaccatccggacagcccgaacccaagctgaagaacgagaaatgat

SEQ ID NO: 104828 - DNA, 844 bp, Homo sapiens
  Payload ID: 586
  Gene Symbol: AP1G1
  Gene Name: adaptor-related protein complex 1, gamma 1 subunit
  ENST ID: ENST00000563259
  CDS Start-End: 284-844
ccgtcctctcggaaccggacatcggcctcgcctctctctaaccttccgaccaacttctttcccaatttttcgtgtgtgtgtgtatatgttgttgttttgtttttttcaacctacctgcgagtatactgtttacccttttctcagctcctggccctgcggacgtcagcgtctaataattctcccggtcttcctgattgcctgaaagagtcgggacggttcggttgattgtgtttcccggttaggactcggtgtaggagatccatcgaaccactcgctcaggaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaac

SEQ ID NO: 104829 - DNA, 559 bp, Homo sapiens
  Payload ID: 586
  Gene Symbol: AP1G1
  Gene Name: adaptor-related protein complex 1, gamma 1 subunit
  ENST ID: ENST00000569185
  CDS Start-End: 141-559
cttgaacccttgactttctcaggctgcgatctttgagggctcattcagggagcctggggtttagcggggcgggccccacccccgcgtgtcttctctgagccacgtatcagcgttcttgtgtcttgtacccgtgtcagaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcagg

SEQ ID NO: 104830 - DNA, 619 bp, Homo sapiens
  Payload ID: 586
  Gene Symbol: AP1G1
  Gene Name: adaptor-related protein complex 1, gamma 1 subunit
  ENST ID: ENST00000565412
  CDS Start-End: 363-619
cactgctgccgccgcccccggagctgctggtttcattcgaggtttcgggccgtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgctcctggccctgcggacgtcagcgtctaataattctcccggtcttcctgattgcctgaaagagtcgggacggttcggttgattgtgtttcccggttaggactcggtgtaggagatccatcgaaccactcgctcagggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggcta

SEQ ID NO: 104831 - DNA, 2494 bp, Homo sapiens
  Payload ID: 586
  Gene Symbol: AP1G1
  Gene Name: adaptor-related protein complex 1, gamma 1 subunit
  ENST ID: ENST00000565009
  CDS Start-End: 224-850
tgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctgctgccactgctgccgccgcccccggagctgctggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtaatgtaatttggatgacctgcttattcatgagacattcttcaatattcactgttttttgatgcatctttcttctctgcagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtaaaatacatctccttggttatttcgtgtgcaaagattgggatcacaagatcgtgcaaggacgtcagcacatctggcagtacttggtgttcacagagtgcatacctgggtctttgtttcatttccactataaatttcttaactgtttttaatttttcccttctgcaaggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtaagatttaatttttacctttattggtaaagtctgcttggaacttttggaagtgcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaag

SEQ ID NO: 104832 - DNA, 606 bp, Homo sapiens
  Payload ID: 586
  Gene Symbol: AP1G1
  Gene Name: adaptor-related protein complex 1, gamma 1 subunit
  ENST ID: ENST00000567583
  CDS Start-End: 332-606
atgttcggttcctgctgccactgctgccgccgcccccggagctgctggtttcattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgct

SEQ ID NO: 104833 - DNA, 3298 bp, Homo sapiens
  Payload ID: 587
  Gene Symbol: AP1G2
  Gene Name: adaptor-related protein complex 1, gamma 2 subunit
  Uniprot ID: O75843
  ENST ID: ENST00000308724
  CDS Start-End: 757-3114
aaaaaaaatatattaataaaaaagttcaaaaaaggggggggattgtcatctcctttggggtgcgatggcttcaaatccaaactgaggctctccgggtggtaaggatgtgcgaggaggcctcttgaagaactccaggcctatcatgctgtctctccgctaaagcctgaggcccgaggtcagaggattcaggaaggctctgcagtcggcccaggagggcggggtcccgtggtggaggcggggagagggaaggaccgcacggagcaccaacccctgctcggccccgtaccaggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggtagggggaggaaacggtagagagaaataggtggggctcccgcgcatgctcaataggaaggggcgccggtggggtgcggacgcatgcgtagtgggcttctcgggcggtggggtgggcgcggaatttggagacccacttcgggaaaggtaaaatgcgggcgcaattttagggtacctgtgggacccgggctcttagggtcttgacacaggacgggcctgggccgaaagcccaggcacgcccgaccagagagtgtttctccactcccggactctgccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaatgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagccata

SEQ ID NO: 104834 - DNA, 2609 bp, Homo sapiens
  Payload ID: 587
  Gene Symbol: AP1G2
  Gene Name: adaptor-related protein complex 1, gamma 2 subunit
  Uniprot ID: O75843
  ENST ID: ENST00000397120
  CDS Start-End: 71-2428
cccctgctcggccccgtaccaggaagcgctggggggcagaggagcggagttgaggcagaagccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaatgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagcc

SEQ ID NO: 104835 - DNA, 561 bp, Homo sapiens
  Payload ID: 587
  Gene Symbol: AP1G2
  Gene Name: adaptor-related protein complex 1, gamma 2 subunit
  ENST ID: ENST00000557162
  CDS Start-End: 1-430
tgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccaggtcacagctgcttacacagtgcagaagacat

SEQ ID NO: 104836 - DNA, 592 bp, Homo sapiens
  Payload ID: 587
  Gene Symbol: AP1G2
  Gene Name: adaptor-related protein complex 1, gamma 2 subunit
  ENST ID: ENST00000554477
  CDS Start-End: 1-592
gaggaagtgctggcattgctggaaaaggtgctgcagtcccacatgtccctgccagccactcgaggatatgccctcacagccctcatgaagctcagcactcgcctctgtggggacaacaaggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctc

SEQ ID NO: 104837 - DNA, 747 bp, Homo sapiens
  Payload ID: 587
  Gene Symbol: AP1G2
  Gene Name: adaptor-related protein complex 1, gamma 2 subunit
  ENST ID: ENST00000556943
  CDS Start-End: 53-259
ccaggaagcgctggggggcagaggagcggagttgaggcagaagccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggccc

SEQ ID NO: 104838 - DNA, 656 bp, Homo sapiens
  Payload ID: 587
  Gene Symbol: AP1G2
  Gene Name: adaptor-related protein complex 1, gamma 2 subunit
  ENST ID: ENST00000553756
  CDS Start-End: 193-399
aggaagcgctggggggcagaggagcggagttgaggcagaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagtgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatca

SEQ ID NO: 104839 - DNA, 562 bp, Homo sapiens
  Payload ID: 587
  Gene Symbol: AP1G2
  Gene Name: adaptor-related protein complex 1, gamma 2 subunit
  ENST ID: ENST00000556843
  CDS Start-End: 153-562
agaagccaggtgaggctggagtcctggggtaggcaggctgtcgctgccgctgccgctgcctgagatggaaatcgggggaggaagctcgcggaagaaacagcggagggtcgtggaaaaaaaagcaatggctgagctagggatggggtaccaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaatgacctgagccaggggattcagccagtacaaggcctggccttgtgcactttgagcaccatgggctctgctgagatgtgccg

SEQ ID NO: 104840 - DNA, 678 bp, Homo sapiens
  Payload ID: 587
  Gene Symbol: AP1G2
  Gene Name: adaptor-related protein complex 1, gamma 2 subunit
  ENST ID: ENST00000557189
  CDS Start-End: 78-678
cggagcaccaacccctgctcggccccgtaccaggaagcgctggggggcagaggagcggagttgaggcagaagccaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaatgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacgg

SEQ ID NO: 104841 - DNA, 13193 bp, Homo sapiens
  Payload ID: 588
  Gene Symbol: AP1M1
  Gene Name: adaptor-related protein complex 1, mu 1 subunit
  Uniprot ID: Q9BXS5
  ENST ID: ENST00000291439
  CDS Start-End: 450-1721
acacttgtttcatagacttccccaccagactgtgagctccatagggctgggccccaggtcggtttcaccaccaggctctctcgcctaactcggcccacgggaggccgtttccagctgctctggctccatagctcagcctggcagcggccactgggtgccctgatttggtcggccccgccccaccgggccttacttccgggatgcttctggcgggagcaagaaacatggttacatacgacgtaatgcgcctgcgcacagtccgtcctgcgcctgcgcattcctgacagcacctcccggaccggacataacggtccccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccggcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactccacagccttcctctgatgcagcgtggtcccaactcctcctgcgtgaccacagggcttgcctggttttgtcgccgaccttccctgtggccccacgaggtgtcaccagctccctctgcttccccagctgaaacacaggaaaagcagctgcgggaagaggcagctgcagtgctggaccatgggccaccactcctgggccacacagaggaggccacagaggcagagtcttctctcatccaatctgctgcaccctcagatggccaacagcttgtccccacctctccccaaactgatggcccactcagagcatggtccttgtgtccacagcagcatcccctgtgtcctagctagaaatgcaggttcgtgggccagccctgacctgccaaagtggaggctctggggccagggtcccggaaaacattaacaaggcccccagatgcttcttctgtgaactgctacttggtccatgggggaaatagcacatatgcaggaagtgctgcctgctcttggccccctccccgaccagtgctgatggccctgcctggccagcaccctcttgccttcattctccccctccctctcctgtcttgccgagctcgtcctcaggtgtctagtgggcatccgacctaacagcctgagtagaaccttccgcccacgtaggtcttccccatctcagtcaatgacgctgccccagcccaggcctcagaccaaagccctgaaggcatccctggggcccctcccctcactgtccacacccatatcagcagccagccctcatggcccctccagaaaaccctggggctgaccccatttgccatcctcgctgccacccccggggcctagctccagtgtgggctgtcactgtccccaccctgtggagcccccatgctgggacaccgcagggacaggagagggctggtccacaggacagaagagagacttcagtttccagcaacttatcagataagacctgcaaaccctccactacagactgtagaaatgcaggaaatgaagcagacgcacctagccgtgcccataaaaaagcaaggagacccacaggagcccaagacgaaggaagtagacgcggaagacaccgtgggggctcacaccggagttgctcttggaaaccaccgggtttaggtttgggggccaggtggcagataggactttgggcatcgggaagatggtgaaatgcagtggagatgactcctgcgtgaagctgggatcctcgagggtcatgatacttaacagtaaaaagatggactagaaaaaacatttgccctccacccctgagaataagcactgtgtcctctctctgcctgagatccacaggagaaaaagtcaccactcatttagaccccacgcttgtaatatcaatctggtttgcagacaaccaggccaagatgtttatgacagaaaacctccctggagggacctaacttcatgccttgttacctaagatcctcgcacacaatagaccctcaacatgagggcacatcctgaaaattacaaaacacgtgcatgaaagcaaacttgaaacagcaggatcagatcctcacgaacttcaaagattatcggcatgtaaacaaatacactatgcagtcaatctgttgcaagtgcctaaaggcacagagactctgaatagaaaagagcaaaatgctgttaagacagagctgttacaacatccaacaaggcaaataatttgcatgcgggttataacgtctacaaatcagaaaaagagaacctaacaaaatgggctgtgtgtgaacagacagtatgaagaagatgaaatacaaatggcgaccgttcggccaggcgtggtggctcacgcccgtgagcccaatactttgggaagccgaggcagaccgatcactggaggtcaggagttcgagaccagcatggccagcatggtgaagccccatctatactaaaaatacaagaattagccgggtgtggtggtgcgtgcctgtaatcccagctactcagtatgctgaggcaggagaatggcttgaacccaggaggtggaggttgcagtgagccaagatagtgttactgcactccagcctgggcaacagagcgagactccgtctcaaaacacaacaaaaaccggcctagcgcagtggcttatgcctgtaatcccagcactttgggaggctgagacgggtggatcacctgaggtcaggagtccgagaccaacctggccaacatggcgagaccccatctctactaaaaataccaaaattagccaggcatggtggcgggcgcctgtaatcccagctacttgggaggctgaggcatcagaatcatttgaaccccaggaggcagaggttgcagtgagccgagatcataccacctgcactccagcctgggcaacagagcaagacttcatctcaaaagaaaaaaaaaaggcaaacgttcaaccatgtagctattcaggaaatatgtacacataaaccaagaccacagttagatgctatttgcatcatgtcggccccccccaaaaaaatttttttttttgagacagggtcttgctatgttacccaggctggagtgcagtggcgtgatcacggctcactgcagcctcgagctgccaggctcagccaatcctgcctcagcctcttgaggagctgggactacaagcacatgccaccatgctgggccaatttttcatattttttatagagatggggtctcgtcattttgtccacactggtctccaactcctgggcttgagccatcatcctgccttggcctcccaaagtgctgggattacaggcgtgagccacctcgccacgcctcctgaacatctagaacgtgctagctatgtactgactgtgggaaagttgagaacatcctccctgaagtcatctttatgccagaattctcttgcagaactctagttgagaaaagccctgagaagtccatgcaccaatatatagagaaatatcaggtgtacagttacacttacagcagcatagttcatgatagcaggaaattggaaagcaaccaaaagtccttcaataggaaaagggaccactgtagtccattcatgcaagagattacagcagtgaaaatgaattcaactagagcagtgatatggctcagaatacaacttaaacaacattgagcgggaaaaatgtttacaaaagaaaatgcagtaatctagtataaaatacggaaataatattttgcgtgcttagggatctatatatatccagcaaaagtctaacgagatgcttgagaatttgaaaaaattcacatccctggttatctctgaaaggcaaaaacaggaagggggtatgactggggcctctgctgtgttggcaatttccttaagcttggtattgcttagtggcttgttctgtattctttctttatgctttttttttttttttttgacagggtgtcactctgttgcccaggccaaagtgcagtggcatggtcacggctcactgcagcttcaaactcctgggctcaagtgatcctcccaccttggcctcccaaagtgctgggattacaggcatgagccacagtgcccagccctttttgtagttcttaatatactttttgtagtttttttgttttttgtttttgtttttgttttttttgagacagagttttgctcttgttgcccaggctggagtgcaatggtgtgatctcggctcactgcaacctccgccttctgggttcaagcaattctcctgcctcatcctcctgagtagctgagattacaggcatgcgccaccatgcctggctaattttgtatttttggtagagacgggatttctccatgttggtcaggctggtctcgaactcccggcttcaggtgatccgcccccctcaccttcccaaagtgctgggattacaggcatgagccaccgcgcccggccagttctcttttttttttttttttttttttttttttttttttttttttaagactgcaaagctgggcatggtagtatgcacctgtagtcccaactacttgggaggctgaggctagaggattacttgagcccaggagtttaaggacagcctgggcaacatagtgagaccctgtctctaaaacaaaccaacaaaacaccccccaaaaatgacaatgcagatttggaagaaaaaaatagattaaaaatgtagtcataggaattaacaacttggggccgggcatggtggctcacgcctataatcccagcactttgggaggctgaggcggccagatcattttaggtcaggagtttgagaccagcctggccaacatggtaaaacctgattgctactaaaaatacaaaagaattagctgggcgtagtggctcatacctgtaatcccagctactcaggtggctggggcaggagattcgcttgaacccgggagatggcgctcgcagtgagtcaagatggcaccgttgtactcttgcctgagcgacacagtgagacactgtctcaaaaaaaaaaattaacaacttggttggagggtgttaaaatacaagtgagacatagatgaagagaattagtgcactagaagagagctgtctgaggcagttacccgggacatagcacagctaatgagacatatatatatttacagtcaaccctccacatccatgggttctgcatccatggattcaaccaagagtgagttgaaaatatttgaaaaacaattgtgtctgtgctggacatgtacaggttttcttttttattgtcattattccttaaataatacagtataatgattatgtagcatctacattgtattaggtaatctagagatgatttaaagatgatgtgcataggatatatgcaaatattgtgccattttatataaaagacttgagcatcctcagattttggtatccaaggggagtcctggaagcaatcccttgaggatatggagggacgactctgtgtgtgtgtgtgtgtgtgtgtgtgtgtgtatgtgtgtgtgtgtgtgtgtgtgtgtgtgatgtgcgtgtgtggttagcacaagacaataagaaggcccaacatgccagcaagtatctaacacaaaccaaaaaatgagaactggggagcagccacatgcaaagagatcgtggccagaattttccaaaattaatgaaaatcttgaagtgttttttgtttttcattttgacggagtttcgcgtttgttgcccaggctggagtgcaatggcgaaatctcggctcattacaacctctgcctcccaggttcaagcaattctcatatctcagcctcccaagcagctgggattacaggtgcacaccaccacgcccggctaatttttgtattttttgtagagatggggtttcactatgttggtcaagatggtctcgaactcctgacctcaggtgatctgcctgcttcggcctcccaaagtgctgggattacaggcatgagccactgcgcccagcctgaaaatcttgaaattttaagatccaggaaaccgttgagtccaaagcatgatacacaaacctaaattcgtaactaaaataatcatagtcgaaccacagaacatatcagactcagggaagatcctaacagcaacactaagagattaaaatgtctctccaaagagcaattggacagagaactggtttcacaactggaacaacaaaagtccgaagatagagcatggcttcaaattactgagagaagtgcagtctagaattctgagcccacctcatctgtaaaaggtaggacaagccgggcatggtggctcccgcctgtaatcccagcactctgggaggccgaggcgggcagaggtcaggagtttgagaccagccggaccaacaaggagaaaccccatctctactagaaatacaaaattagccaggtgtggtggcgggcacctgtgttcccagctacttgggagactgaggcagacagaattgcttgaaccagggagacagaggttgcagtgagccgagatcgcgccactgtactccagcttgggcaaagtgagattctgtctcaaaaaaaaaaaaagacaagataaaaacaatttatcaataacagattccccgaaaaaaggaacttgtgtacataaggaaaggaagaaagatgtgagaaggaatgccggaaaaccttagaaaccattggatctgtctaaactgtcattgactgtgtaaagcaataataacagtgactaacgtatagagtagcgacaaaaggcgcaactgaagtactagacaacatcctggtgttcatgcctttcaaggtcactatgctatttgggaggagattcggctaaagtccacgagggccacgtatttatatataatttctagaccagtggttggaaaagggttgaaagaaaacttttaacagattaataggaagaaggaaaagagaaggaggcgtagaaaaatcaggaggcactgggcgcggtggctcacgcctgtaatcccagcactttgggaggctgaggcaggcggatcacctgaggttgggagttcgagatcagcctgactaacatgagaaaccccgtctctactaaaaatataaaattagccgggtgtggtggtgcatgcctataatcccagctactcgggagggtgaggcaggagaatcgcttgaacctgggaggcagaggttgtggtgagctgagatcgcgccattgcactccagcctgggcaatgagcgaaactccatctcaaaaaaaaaaagaaagaaaaagaaaaagaacaatcaggaggccaggttcagtggctcatgcctgtaatcccagtgctttgggaggctgaggctgagacaggtgaattgcttgagcctaggagtttgagaccagcctgggcaacatggagaaactctgtctctacaaaaattagccaggcatggtggcgcacacctgtagtccaaactactcaggaggctgagttgggaggatcacctgagttcaggaagctgaggctgcagtgagctgtgattgcaccactgcactccaggttgggtgacagagtgacaccctgcctcaaaaaaaaaaaataaaataaaggaaaaatcaggataaatgcagggatgttctaaactttttaaaataataaataatagtacttaaaactgcactgggacttttgggacacccctagcatctctggctgcagaaagcataaaataagattgtagaaataaatccagatattaggaaccacaacaggtgtaaatgaagcaaagctgctagttgaagatgttgtcggattgaactgaaatacaaaatcctgtgatatcctgtttatacgcgatacatctaaaatgtaagtacacaacacaattgaaagtaaaaaaacattaaaagatgtgacacttaaaatataagcacacaacacagttaaaagtaaaaagacattaaaagatgccaaaagaaatctcatatggttatattaattccagacagaatagatgtatttatttatttattcattcatttaattttttgagatggagtctcgctctgtcgcccaggctggagtgcagtggcgcgatctttgcttactgcaacctccgcctcccgggttcaagtgattctcctgcctcagtctcctcagtagctgggattacaggcatgcaccaccatgcttggctaaatttttttatttttgtattttttttatttttagtagagacagggttttgccatgttggccaggctggtcttgaaccctgacctcaggtgatccacccccactggcctcccaaagtgctagtggcaggtgtgagccaccacacacggccagaatagactttaaagcaagaaagcaaaagaaaaaatgtattagatccccgagaagtttccacacaactccaagaattattattagagttcccactctctgaggaattttcaagagaaattagttagaattcaacaagaaataaattactttaaaatatttccaaatatgagaggttttttttgtttttgtttttgtttttgtttttgtttttgttttgagaaagggtctctgttgcccaggctggagtgcagtcagtggcacgatgtcagctcactgcaaccttggcctcctaggctgaaatagtcctcccatctcagtctcacaagtagctgggattacaggtgagcaccaccaagctcagctattttttttttttttttgtatttttagtagagatggagttttgccatgttgcccaggctggtcttgcacttgggctcaagtgatccacctgcctcagcctccacagtgctggaattacaggtgtgagtcaccatgcccagccaatatgagagattttaaagcacatttttcaatcaccatgtgtcaaagaagaaaatataatggaagttagaaaatattagagaatggccaggtgcagtggctcatgtctataatcccagcactttaggaggctgaagcaggtgaatcacttgagctcaggagttcgagaccagcctggccaacatggcgaaaatccatctctactaaaaatacaaaaattaaccaggtgtagtggcacacgcctgtaaatcccagctactcaggaggctgaggcccaagaatggcttgaaccctggaggcagaggttgcagtgagctgagattgtgccactgcactccagcctgggcaacgaaacgagagtctgtctccaaataaataattagagaatatttttcaatctggatgcaggtgacatgggtgtgctctcgagaatccatcaagcattgatgatttgcacactcttttgtgtatatgttacacttcagcaaaaacattcacaaaggggaaaaaggcaaaagatacttaaagcagccagaggtaaagacacatcaccttcagacatgacaaccagacagacagacagctggcttttcaaaggaacccagaaaacagttgggtgacattttcaacatgctaaaagaaaaccactaacccaaatcagagacccagcaaaagtatttcaagaatgaggttacagtaaaaacattttgcagacaaataacgaaagagtttgccagcagcaggctaacactaaagaaaattgtaaacagtgtactcacatcaggcacaaggaaagtgatctcagacggaagggcatgatgcaagaagaaataaaagcaaagaagtagaaaatacatgagaaaatctagacaaagattgcataaacagtttctggagtttttttaagtgatagaattatacaacaggaaaaaaagtctgcagggagtaaactgagttaaaatgttccaagttaatgactgtctgggaggagaataaataacatggatacactttgggaggccgaggcgggcggatcacgaggtcaggagatcgagaccatcctggctaacacggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaataaataaataaataaataaataacatggataaaatttgttgtttgttgttgttgttgttgttgttgttgttgttgagacggagtttcgctcttgttgcccaggctggagtgcaatggcgcggtctttgctcactgcaacctctgcatcccgggttcaagctattctcctgcctcagcctcctgagtagctgggattacacgatgcgccaccaggcctgcctaactttgtatttttggtagaggcggggtttctccatgttggtcaggctggtctcaaactcccgacctcaggtgatccgcccgcctcggcctcccaaagtgctgggattacaggcatgagccactgcgcccagccaaatctgcattttgataagtatgcattttactatctaagggagctaaaacatttttattattttagcactgtaactttgcttttcttctttgttttgtttttttgagacagagtctcactctgtcgcccaggctggagtgcagtggcgtgatctcagctcactgcaacctccacctcctgggttcaagcaattctcctgcctcagcctcctgagtagccaggattacaggtgcacgccaccacacccagctaatttatgtaattttatagagttgtggtttcaccatattggccaagctggtctagaactcctggcctcaagtgatccacctgcctcggcctcccaaagtgcggggagaccagaattccacccagaatgacctctctgttcctaggagtgtgacagcatttgggggggaaaatagcgtagagttggaatttttaaaattcagtttgacaaaatgacttttagctggagcattaagtccctttacatttaatgtaataactgatattacatttaagtataaatttaaatctaccgtcttactttgttttctatttttgtcctttctatgttctcttttatgtcctctctggatttattacagattgtttgtggcttttaaaaaaagtcattgcttgaatgatgagagcttatatttaaaaaggcagggggctaaaataaataaataatttaaaaaataaaaat

SEQ ID NO: 104842 - DNA, 2311 bp, Homo sapiens
  Payload ID: 588
  Gene Symbol: AP1M1
  Gene Name: adaptor-related protein complex 1, mu 1 subunit
  Uniprot ID: Q9BXS5
  ENST ID: ENST00000444449
  CDS Start-End: 94-1401
ggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttgggtaaatacccaggagtgggatggctgggtcacacggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccggcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 104843 - DNA, 1578 bp, Homo sapiens
  Payload ID: 588
  Gene Symbol: AP1M1
  Gene Name: adaptor-related protein complex 1, mu 1 subunit
  ENST ID: ENST00000429941
  CDS Start-End: 117-1229
ggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaagggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgca

SEQ ID NO: 104844 - DNA, 1705 bp, Homo sapiens
  Payload ID: 588
  Gene Symbol: AP1M1
  Gene Name: adaptor-related protein complex 1, mu 1 subunit
  ENST ID: ENST00000590756
  CDS Start-End: 174-1229
attcctgacagcacctcccggaccggacataacggtccccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtactgagggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctg

SEQ ID NO: 104845 - DNA, 546 bp, Homo sapiens
  Payload ID: 588
  Gene Symbol: AP1M1
  Gene Name: adaptor-related protein complex 1, mu 1 subunit
  ENST ID: ENST00000590263
  CDS Start-End: 137-546
attcctgacagcacctcccggaccggacataacggtccccgcgcggctccccgaaccggaagtggaggtgagctgtcgcgggcggcgcccggccttgctcaacgcccagcagtccccaccgcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactca

SEQ ID NO: 104846 - DNA, 564 bp, Homo sapiens
  Payload ID: 588
  Gene Symbol: AP1M1
  Gene Name: adaptor-related protein complex 1, mu 1 subunit
  ENST ID: ENST00000591775
  CDS Start-End: 189-564
ttatgagccccatcctggtgtgaggcagagaggccggtagacctcacctgagagccccatcctgtttctgggtaaccgggcgggggtcttaagtgggtaatccccgccctgttgctacgtaacgcggtgggctgcagccaccgcgttgccaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagcca

SEQ ID NO: 104847 - DNA, 549 bp, Homo sapiens
  Payload ID: 588
  Gene Symbol: AP1M1
  Gene Name: adaptor-related protein complex 1, mu 1 subunit
  ENST ID: ENST00000590945
  CDS Start-End: 358-549
gctaggtaaccggcttatgagccccatcctggtgtgaggcagagaggccggtagacctcacctgagagccccatcctgtttctgggtaaccgggcgggggtcttaagtgggtaatccccgccctgttgctacgtaacgcggtgggctgcagccaccgcgttgccagcagtggacaggggttctggatgctgtatatcctgacccacaggctatgaaagagagagaccaggaagagggcttctcccttcaggccacctgtggacttcagtaaatacgaaccttcagcgggagtgggcgccctgacacaggcgggagagcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtg

SEQ ID NO: 104848 - DNA, 642 bp, Homo sapiens
  Payload ID: 588
  Gene Symbol: AP1M1
  Gene Name: adaptor-related protein complex 1, mu 1 subunit
  ENST ID: ENST00000586543
  CDS Start-End: 1-530
tatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 104849 - DNA, 562 bp, Homo sapiens
  Payload ID: 588
  Gene Symbol: AP1M1
  Gene Name: adaptor-related protein complex 1, mu 1 subunit
  ENST ID: ENST00000589822
  CDS Start-End: 248-562
accgtcgctgccgccgccaccgccctcggccgctgccgaggcctcctgcagccatcatgtccgccagcgccgtctacgtgctggacctgaagggcaaggctatgaaagagagagaccaggaagagggcttctcccttcaggccacctgtggacttcagtaaatacgaaccttcagcgggagtgggcgccctgacacaggcgggagagcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctg

SEQ ID NO: 104850 - DNA, 436 bp, Homo sapiens
  Payload ID: 588
  Gene Symbol: AP1M1
  Gene Name: adaptor-related protein complex 1, mu 1 subunit
  ENST ID: ENST00000589782
  CDS Start-End: 1-387
aacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtaggcctcttttctttccttcttctgtagggttttatctcttccacgatagaaataaacacagcattttaaaactggc

SEQ ID NO: 104851 - DNA, 1749 bp, Homo sapiens
  Payload ID: 589
  Gene Symbol: AP1M2
  Gene Name: adaptor-related protein complex 1, mu 2 subunit
  Uniprot ID: Q9Y6Q5
  ENST ID: ENST00000250244
  CDS Start-End: 84-1355
gcgcttccgcaggaagaaggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtcattaaaaagatgaatct

SEQ ID NO: 104852 - DNA, 736 bp, Homo sapiens
  Payload ID: 589
  Gene Symbol: AP1M2
  Gene Name: adaptor-related protein complex 1, mu 2 subunit
  ENST ID: ENST00000591240
  CDS Start-End: 1-736
gctgtcttcattctggacgttaagggcaaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagat

SEQ ID NO: 104853 - DNA, 510 bp, Homo sapiens
  Payload ID: 589
  Gene Symbol: AP1M2
  Gene Name: adaptor-related protein complex 1, mu 2 subunit
  ENST ID: ENST00000589348
  CDS Start-End: 1-133
aaacgtcgtgatttggagtattaagtctttcccggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtc

SEQ ID NO: 104854 - DNA, 1757 bp, Homo sapiens
  Payload ID: 589
  Gene Symbol: AP1M2
  Gene Name: adaptor-related protein complex 1, mu 2 subunit
  Uniprot ID: Q9Y6Q5
  ENST ID: ENST00000590923
  CDS Start-End: 85-1362
ggcgcttccgcaggaagaaggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggcctttcaggcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagctagaagggagaagagatgggggcttgaacacggggcttccttacagccccggatgcagattttagagggagggcaggtgcgggctgtgtgtgtctgtgtgagggcaggtcctggacttggcagtttcttgctcccagcacccgccccttcctcacctcttccttattccataggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 104855 - DNA, 544 bp, Homo sapiens
  Payload ID: 589
  Gene Symbol: AP1M2
  Gene Name: adaptor-related protein complex 1, mu 2 subunit
  ENST ID: ENST00000587069
  CDS Start-End: 1-387
gagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcggctgggagagaaactctctctgcttccctcgcccttggagctttccccatccccctgattttatatgaagaaatagaagaggggcttgaagtcctcctcgcgagtgccttcttgcaattacctgccttagcgggtgttgcgggtccctccttcacagccgctgagcccagaggtcccgctggcccctcctctgaattttaggatgtcattaaaaagatgaatcta

SEQ ID NO: 104856 - DNA, 961 bp, Homo sapiens
  Payload ID: 589
  Gene Symbol: AP1M2
  Gene Name: adaptor-related protein complex 1, mu 2 subunit
  ENST ID: ENST00000591676
  CDS Start-End: 65-961
gaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctactgtatccaccccacgtggtgtccctggaggtgggtgtgggggctgtcggcgatggtggcagctcaggccaagagagggtgggctgaggacaggagttgcaccgcacatctctgtggcttaggctggggggcaggggcaggtagagatgagggtggtggcaagggacagggtggaggttcggggtctgtattccatttacttctccataaatggcaccttttccttaaccttgctgccccagtggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctc

SEQ ID NO: 104857 - DNA, 543 bp, Homo sapiens
  Payload ID: 589
  Gene Symbol: AP1M2
  Gene Name: adaptor-related protein complex 1, mu 2 subunit
  ENST ID: ENST00000589571
  CDS Start-End: 69-185
gaaggaagcggcgccgccatcgcctcccggcgctccctccccgactcctaagtccttcggccgccaccatgtccgcctcggctgtcttcattctggacgttaagggcaagagggatcccgctatgttgccaaagctggtctcaaactcctggcctcaagggatcctcctgccttggtcttcatgaccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagt

SEQ ID NO: 104858 - DNA, 850 bp, Homo sapiens
  Payload ID: 589
  Gene Symbol: AP1M2
  Gene Name: adaptor-related protein complex 1, mu 2 subunit
  ENST ID: ENST00000589684
  CDS Start-End: 133-850
aagtccttcggccgccaccatgtccgcctcggctgtcttcattctggacgttaagggcaaggtgaggctgggcatgaggagttgggagacggacagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggccgcagcaagaacaaatcagtagagctggaggatgtaaaattccaccagtgcgtgcggctctctcgctttgacaacgaccgcaccatctccttcatcccgcctgatggtgactttgagctcatgt

SEQ ID NO: 104859 - DNA, 336 bp, Homo sapiens
  Payload ID: 589
  Gene Symbol: AP1M2
  Gene Name: adaptor-related protein complex 1, mu 2 subunit
  ENST ID: ENST00000592285
  CDS Start-End: 1-312
ttcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcggtaaggcagcccagctcctggggacaatggggtgagggaaaggcagtgggtagggactc

SEQ ID NO: 104860 - DNA, 1306 bp, Homo sapiens
  Payload ID: 590
  Gene Symbol: AP1S1
  Gene Name: adaptor-related protein complex 1, sigma 1 subunit
  Uniprot ID: P61966
  ENST ID: ENST00000337619
  CDS Start-End: 119-595
ggcgggacggggcggggcttcgggcgagagggagggcagcaggagaaaggataagaaagggagtgggactggcgcctacggtggccgaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcaccccagatgtccttccctccctaataactgtaaatatataaatatgtcaggttaaagggaaaaggtgttcagggcacttcttgtcctctctgtcccataacctacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaagtaaaagcatttctggac

SEQ ID NO: 104861 - DNA, 573 bp, Homo sapiens
  Payload ID: 590
  Gene Symbol: AP1S1
  Gene Name: adaptor-related protein complex 1, sigma 1 subunit
  ENST ID: ENST00000429457
  CDS Start-End: 1-573
gtgcgaagagggaggggagggggaagcgaggggcgtgggctgcacctgcgggggtcctcgggggccgccctcggggtgaaccgccctgtcttccctctggtcctcagaggcctcccttgcctcggcggatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacgga

SEQ ID NO: 104862 - DNA, 741 bp, Homo sapiens
  Payload ID: 590
  Gene Symbol: AP1S1
  Gene Name: adaptor-related protein complex 1, sigma 1 subunit
  Uniprot ID: P61966
  ENST ID: ENST00000443943
  CDS Start-End: 33-509
gaagtgggacgcgccgagccggaggctgcaggatgatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagagatatgccagcctctacttctgctgcgccatcgagggccaagacaatgagctcatcacactggagctgatccaccgatacgtggagctcttagacaaatactttggcagtgtgtgcgagctggacatcatcttcaactttgagaaggcctacttcatcctggatgagtttttgatggggggggatgtccaggacacctccaagaagagtgtgctgaaagccatcgagcaggctgacctactgcaagaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggaatttcatttcctgtattttatctggccaccctaccttaaacggatttttatgcccaatgcgtctccaaacgggctgcccccaactccctgagctgcctttatgga

SEQ ID NO: 104863 - DNA, 2237 bp, Homo sapiens
  Payload ID: 591
  Gene Symbol: AP1S2
  Gene Name: adaptor-related protein complex 1, sigma 2 subunit
  Uniprot ID: P56377
  ENST ID: ENST00000329235
  CDS Start-End: 245-718
gcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacataccttttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 104864 - DNA, 3492 bp, Homo sapiens
  Payload ID: 591
  Gene Symbol: AP1S2
  Gene Name: adaptor-related protein complex 1, sigma 2 subunit
  ENST ID: ENST00000380291
  CDS Start-End: 118-600
gggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgta

SEQ ID NO: 104865 - DNA, 530 bp, Homo sapiens
  Payload ID: 591
  Gene Symbol: AP1S2
  Gene Name: adaptor-related protein complex 1, sigma 2 subunit
  ENST ID: ENST00000450644
  CDS Start-End: 1-440
gtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagccacgtcatgaatattttaatgtccctgtgtactaaatgactactcatcgagtatgcagaatttcacagaggaaatagaatgctgatatacatatgaaagaaaatatcctcagcatggtgatttat

SEQ ID NO: 104866 - DNA, 991 bp, Homo sapiens
  Payload ID: 591
  Gene Symbol: AP1S2
  Gene Name: adaptor-related protein complex 1, sigma 2 subunit
  ENST ID: ENST00000452376
  CDS Start-End: 1-460
gttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagagccagaatgaagaatggggaggtttgtctgaggatatcttatgataaagagcagtctaaggctttagtccctttgatccccaacttatttattggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaa

SEQ ID NO: 104867 - DNA, 810 bp, Homo sapiens
  Payload ID: 591
  Gene Symbol: AP1S2
  Gene Name: adaptor-related protein complex 1, sigma 2 subunit
  ENST ID: ENST00000545766
  CDS Start-End: 328-810
ctcagcgaagaaacctccaatcggctgccttggactcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggatgcgaaagaagctgaaaccccacgtagtgttcttgaagaaattggactgacataa

SEQ ID NO: 104868 - DNA, 2201 bp, Homo sapiens
  Payload ID: 592
  Gene Symbol: AP1S3
  Gene Name: adaptor-related protein complex 1, sigma 3 subunit
  ENST ID: ENST00000334271
  CDS Start-End: 121-366
agccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacaaggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctcaagaaaaaaaaaaaaaaaa

SEQ ID NO: 104869 - DNA, 589 bp, Homo sapiens
  Payload ID: 592
  Gene Symbol: AP1S3
  Gene Name: adaptor-related protein complex 1, sigma 3 subunit
  ENST ID: ENST00000396653
  CDS Start-End: 133-324
attgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtgtctgtgagctggatattatctttaattttgaaaaggcttatttcatcctggacgagtttataataggtggggaaattcaggaaacatccaagaaaattgctgtcaaagccattgaagactctgatatgttacaggaggtcagtacggtttcccaaaccatgggagaaagatgatgatgatgatgatgatggtgttaataattataatattaaccagacttactgagtacttactctgtgctgggtacagtttctaaactatttatatgtatt

SEQ ID NO: 104870 - DNA, 830 bp, Homo sapiens
  Payload ID: 592
  Gene Symbol: AP1S3
  Gene Name: adaptor-related protein complex 1, sigma 3 subunit
  Uniprot ID: Q96PC3
  ENST ID: ENST00000396654
  CDS Start-End: 133-597
attgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaa

SEQ ID NO: 104871 - DNA, 552 bp, Homo sapiens
  Payload ID: 592
  Gene Symbol: AP1S3
  Gene Name: adaptor-related protein complex 1, sigma 3 subunit
  ENST ID: ENST00000409375
  CDS Start-End: 92-505
gtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgagtttaattgctggtttctcctaatgaggctcctgtctgtcttggattcctggtctacgcctgccttgaactccgaggttcctcagcttgctactataactcctgacttctgccttttctgacctctggtctgtgagctggatattatctttaattttgaaaaggctta

SEQ ID NO: 104872 - DNA, 499 bp, Homo sapiens
  Payload ID: 592
  Gene Symbol: AP1S3
  Gene Name: adaptor-related protein complex 1, sigma 3 subunit
  Uniprot ID: Q96PC3
  ENST ID: ENST00000446015
  CDS Start-End: 35-499
ctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggaggtcagtacggtttcccaaaccatgggagaaagatga

SEQ ID NO: 104873 - DNA, 1785 bp, Homo sapiens
  Payload ID: 592
  Gene Symbol: AP1S3
  Gene Name: adaptor-related protein complex 1, sigma 3 subunit
  Uniprot ID: Q96PC3
  ENST ID: ENST00000443700
  CDS Start-End: 153-647
cacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggagaatcgtttgagccccagaggcagagattgcagtgagccgagatcatgccattgcactctagcctaggcaacaagagcaaaactccatctaaaaaaaaaaaaaaagaaaagaaaaaggagaattatgaagaacttggttccacaagtaagatagtcctcatactgcatcagtagtgacttaaacttttttaaaacttttattttttgtggggggatctgttgaatttgggaagcctccagttttaataaaatttttttattatggtggaaacatgtctgtaaaacttaggactatagaaatgcaaagaataaagaactgagggagttacacacatttgtagtcagaaattaagttcaaaaaataatttaggtcatttgcattttttagtatgcaaaataaatggaaaaattaaagtgcaataaaaatataatttgggaaatgaatgcagtaaaattgaaaacattgaaatattataatttaataaaataaacttcaaaaaatgtatgaaaatataagtatctttacttatataggattaaatatatttctgataatctgtcctctataatgaattggtttaattatgtttttctgtttttagaaatgggcatctttttatttctggaaacaactttttaatgagattttatcaaacattagactatgactaattataatattcaaagccaataccaaaacgatggataaataaatgaataaaacaaggcacattaatagaaaaaaatgaatgaaatcaattacgggttctacttgaaacacctaatctcattataatagcaataataaaacaatttgtacatactttattagtcgaacatttattaaaaatataagagcatagagcaaattaatttggaagaaaatttaaatcttttacatacaaataccctcaagaataataaatcatggagtattaataaaattaaaccagctgataattttagaaagtgcttcatgcacagagacttttattcaagtcctctttgctttctgctagtgcttttttttttttcttgaaatgggatgggatctcactctgtcacccaggctggagtgcagtagcacgatagcagcgcactgcaacctggacctcctgggctcaagcaatcctctcaccgcagcctcctgagtagctggggctacaggtgtgtgccaccatacttggctaattaaaaaaaaaaaa

SEQ ID NO: 104874 - DNA, 561 bp, Homo sapiens
  Payload ID: 592
  Gene Symbol: AP1S3
  Gene Name: adaptor-related protein complex 1, sigma 3 subunit
  ENST ID: ENST00000444408
  CDS Start-End: 392-561
aaacgtttgcggaaggaatacaggacacactcgcgcggcagaatcgcgaaaagtccccggtgttctccgcgcagggagttccccgcgcagggagttcctagcgggccacgcgctctcgcctgaccacccgcgccgagctgcgggctgtcggggtacagacgcccgcgcgcgcaggtgcattcgctccagatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggaggctattgggggtgatgaataatgatttcattcttggatgaggagaggctcggcgggggaggaggtgactgcatattcgtgggaaaaactgtctccaggttgcttaatgtctgtgagctggatattatctttaattttgaaaaggcttatttcatcctggacgagtttataataggtggggaaattcagga

SEQ ID NO: 104875 - DNA, 2515 bp, Homo sapiens
  Payload ID: 592
  Gene Symbol: AP1S3
  Gene Name: adaptor-related protein complex 1, sigma 3 subunit
  Uniprot ID: Q96PC3
  ENST ID: ENST00000415298
  CDS Start-End: 286-600
ggaggagaaaggggaaaggaagaaagaaggagagcaggagggcgaggagcggggggagcggggaggagggcgcggggaggaggcagcggggaggagcgtgcagggaggaggcagccgcgctgggaggagtctgcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatacttggccttttgcaagagcctgaagaagtttccttgaggtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacaaggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctcaagaaaaaaaaaaaaaaaaa

SEQ ID NO: 104876 - DNA, 3388 bp, Homo sapiens
  Payload ID: 593
  Gene Symbol: AP2A1
  Gene Name: adaptor-related protein complex 2, alpha 1 subunit
  Uniprot ID: O95782
  ENST ID: ENST00000354293
  CDS Start-End: 167-3034
ggtgccacggcctgccagcccgcccgcccgcccgccagccagccctccccgcggccggctcggctccttggcgctgcctggggtcctttccgcccggtccccgcttgccagcccccgctgctctgtgccctgtccggccaggcctggagccgacaccaccgccatcatgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgctaa

SEQ ID NO: 104877 - DNA, 3286 bp, Homo sapiens
  Payload ID: 593
  Gene Symbol: AP2A1
  Gene Name: adaptor-related protein complex 2, alpha 1 subunit
  Uniprot ID: O95782
  ENST ID: ENST00000359032
  CDS Start-End: 1-2934
atgccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggcactgggcagccccttggactgaggcagttttggtggatgggggacctccactggtgacagagaagacaccagggtttgggggatgcctgggactttcctccggccttttgtatttttatttttgttcatctgctgctgtttacattctggggggttagggggagtccccctccctccctttcccccccaagcacagaggggagaggggccagggaagtggatgtctcctcccctcccaccccaccctgttgtagcccctcctaccccctccccatccaggggctgtgtattattgtgagcgaataaacagagagacgct

SEQ ID NO: 104878 - DNA, 2196 bp, Homo sapiens
  Payload ID: 593
  Gene Symbol: AP2A1
  Gene Name: adaptor-related protein complex 2, alpha 1 subunit
  ENST ID: ENST00000597774
  CDS Start-End: 1-172
gccggccgtgtccaagggcgatgggatgcgggggctcgcggtgttcatctccgacatccggaactgtaagagcaaagaggcggaaattaagagaatcaacaaggaactggccaacatccgctccaagttcaaaggagacaaagccttggatggctacaaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctgatcgtcaccaaccgtgatgacgtccagggctatgccgccaagaccgtctttgaggcgctccaggcccctgcctgtcacgagaacatggtgaagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcagctggctgtgcagaccaagcgcgtggcggcgcaggtggacggcggcgcgcaggtgcagcaggtgctcaatatcgagtgcctgcgggacttcctgacgcccccgctgctgtccgtgcgcttccgcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttctgagccctggactctgccccgggggatgtggccggc

SEQ ID NO: 104879 - DNA, 4656 bp, Homo sapiens
  Payload ID: 594
  Gene Symbol: AP2A2
  Gene Name: adaptor-related protein complex 2, alpha 2 subunit
  Uniprot ID: O94973
  ENST ID: ENST00000332231
  CDS Start-End: 214-3036
gctcgcgtgcgtgcgcgtgcgtgctggtgcgggcgccgtacgtgcgcgcgcgcggcggcccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggagggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcatggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgcaccccg

SEQ ID NO: 104880 - DNA, 4575 bp, Homo sapiens
  Payload ID: 594
  Gene Symbol: AP2A2
  Gene Name: adaptor-related protein complex 2, alpha 2 subunit
  Uniprot ID: O94973
  ENST ID: ENST00000448903
  CDS Start-End: 142-2961
ctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggagggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcatggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgc

SEQ ID NO: 104881 - DNA, 3072 bp, Homo sapiens
  Payload ID: 594
  Gene Symbol: AP2A2
  Gene Name: adaptor-related protein complex 2, alpha 2 subunit
  Uniprot ID: O94973
  ENST ID: ENST00000528815
  CDS Start-End: 123-2093
gtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 104882 - DNA, 554 bp, Homo sapiens
  Payload ID: 594
  Gene Symbol: AP2A2
  Gene Name: adaptor-related protein complex 2, alpha 2 subunit
  ENST ID: ENST00000531548
  CDS Start-End: 1-554
gaatttttcttgccaaggttggtggtcactgcttctgggacaccctggttctcttcacagtgttttccgtctggctcctctgaaggtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtc

SEQ ID NO: 104883 - DNA, 935 bp, Homo sapiens
  Payload ID: 594
  Gene Symbol: AP2A2
  Gene Name: adaptor-related protein complex 2, alpha 2 subunit
  ENST ID: ENST00000524559
  CDS Start-End: 665-935
aaaactgtcctttgaaaatagaggaattggctgggtgtggtggctcatgcctgtaatcccagcactttgggaggccaaggtgggtggatcatctgaggtcgggagttcgagaccagtctggccaacatggtgaaaccccgtctctactaaaaatacaaaaattagccaggcgtgttggcgaacgcctgtaatttagctactcaggaggctgagtcacgagaattgcttgaacctgggaggcggaggttgcagtgagccaagattgtgccactgcactccagcctgggtgaacagagcaagatcctgtctcaaaaaaaaagaaattaagatatttccaggtaaacaataaacagaggacatttgttgttttagccaacctcccttataatacatactgaaaggaatgtctcaggctggaatgaaaggacactaggtggtaggatacgtgaagaaataaaagaacaacggtgaagacagctacatatgtcaagttaaaagacaatgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcaga

SEQ ID NO: 104884 - DNA, 557 bp, Homo sapiens
  Payload ID: 594
  Gene Symbol: AP2A2
  Gene Name: adaptor-related protein complex 2, alpha 2 subunit
  ENST ID: ENST00000530801
  CDS Start-End: 377-557
aattatatgacaatattacactgtagcaggacaagccacagacaaaacccctcagacaccgagttaaagaagggctttattcggccgggagctttggcaagagtcaaatcttcaacagccgagctccccgaatgagcaattcctgtccctcttcagggctcacaactctaagagggtccacgtgagagggtcgtgatcgattgagcaagcagggggtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgcca

SEQ ID NO: 104885 - DNA, 527 bp, Homo sapiens
  Payload ID: 594
  Gene Symbol: AP2A2
  Gene Name: adaptor-related protein complex 2, alpha 2 subunit
  ENST ID: ENST00000527024
  CDS Start-End: 112-527
actttgtgcttggtggctggtggctgtccacccatgtgtaccagtgcctgccaacctgaagggctttggcaggggccttcgctgcagggtgaggtctgaggaggagcctgaatgctggttcagttcttccagaggactctcgactctcttctcttgcttggtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccga

SEQ ID NO: 104886 - DNA, 556 bp, Homo sapiens
  Payload ID: 594
  Gene Symbol: AP2A2
  Gene Name: adaptor-related protein complex 2, alpha 2 subunit
  ENST ID: ENST00000534485
  CDS Start-End: 1-556
gtaagggtctggccaagacgcatagaagaaatagcatgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgc

SEQ ID NO: 104887 - DNA, 464 bp, Homo sapiens
  Payload ID: 594
  Gene Symbol: AP2A2
  Gene Name: adaptor-related protein complex 2, alpha 2 subunit
  ENST ID: ENST00000526753
  CDS Start-End: 278-464
gtggcatgtatttctcagtggaattttaaatagaatggtgactcggcatttattccttgtctgaagtaagcaagtaggaaggaccttgttccccattcaagggaatgaacggtgtggtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgg

SEQ ID NO: 104888 - DNA, 1491 bp, Homo sapiens
  Payload ID: 594
  Gene Symbol: AP2A2
  Gene Name: adaptor-related protein complex 2, alpha 2 subunit
  ENST ID: ENST00000534328
  CDS Start-End: 143-1279
gctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacaggtgtgtcggctgcctatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtgtccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 104889 - DNA, 551 bp, Homo sapiens
  Payload ID: 594
  Gene Symbol: AP2A2
  Gene Name: adaptor-related protein complex 2, alpha 2 subunit
  ENST ID: ENST00000525796
  CDS Start-End: 175-551
aaagcggcgctgggaccctgaggcggccgtggttaggcggctccccggcggctcctccgcggcggtgacggcgaccgcactccccgcttcccgctccccgcgctcctccgcccgggtccgccagccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccat

SEQ ID NO: 104890 - DNA, 1282 bp, Homo sapiens
  Payload ID: 594
  Gene Symbol: AP2A2
  Gene Name: adaptor-related protein complex 2, alpha 2 subunit
  ENST ID: ENST00000626889
  CDS Start-End: 1-1070
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacaggtgtgtcggctgcctatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 104891 - DNA, 935 bp, Homo sapiens; identical to SEQ ID NO: 104883
  Payload ID: 594
  Gene Symbol: AP2A2
  Gene Name: adaptor-related protein complex 2, alpha 2 subunit
  ENST ID: ENST00000627737
  CDS Start-End: 665-935

SEQ ID NO: 104892 - DNA, 935 bp, Homo sapiens; identical to SEQ ID NO: 104883
  Payload ID: 594
  Gene Symbol: AP2A2
  Gene Name: adaptor-related protein complex 2, alpha 2 subunit
  ENST ID: ENST00000629923
  CDS Start-End: 665-935

SEQ ID NO: 104893 - DNA, 2883 bp, Homo sapiens
  Payload ID: 594
  Gene Symbol: AP2A2
  Gene Name: adaptor-related protein complex 2, alpha 2 subunit
  ENST ID: ENST00000625871
  CDS Start-End: 1-1904
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtatccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 104894 - DNA, 557 bp, Homo sapiens; identical to SEQ ID NO: 104884
  Payload ID: 594
  Gene Symbol: AP2A2
  Gene Name: adaptor-related protein complex 2, alpha 2 subunit
  ENST ID: ENST00000630212
  CDS Start-End: 377-557

SEQ ID NO: 104895 - DNA, 469 bp, Homo sapiens
  Payload ID: 594
  Gene Symbol: AP2A2
  Gene Name: adaptor-related protein complex 2, alpha 2 subunit
  ENST ID: ENST00000629940
  CDS Start-End: 1-469
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtc

SEQ ID NO: 104896 - DNA, 519 bp, Homo sapiens
  Payload ID: 594
  Gene Symbol: AP2A2
  Gene Name: adaptor-related protein complex 2, alpha 2 subunit
  ENST ID: ENST00000626013
  CDS Start-End: 1-519
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgc

SEQ ID NO: 104897 - DNA, 527 bp, Homo sapiens; identical to SEQ ID NO: 104885
  Payload ID: 594
  Gene Symbol: AP2A2
  Gene Name: adaptor-related protein complex 2, alpha 2 subunit
  ENST ID: ENST00000628115
  CDS Start-End: 112-527

SEQ ID NO: 104898 - DNA, 1282 bp, Homo sapiens
  Payload ID: 594
  Gene Symbol: AP2A2
  Gene Name: adaptor-related protein complex 2, alpha 2 subunit
  ENST ID: ENST00000626798
  CDS Start-End: 1-1070
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacaggtgtgtcggctgcctatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtatccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 104899 - DNA, 519 bp, Homo sapiens; identical to SEQ ID NO: 104896
  Payload ID: 594
  Gene Symbol: AP2A2
  Gene Name: adaptor-related protein complex 2, alpha 2 subunit
  ENST ID: ENST00000626739
  CDS Start-End: 1-519

SEQ ID NO: 104900 - DNA, 527 bp, Homo sapiens; identical to SEQ ID NO: 104885
  Payload ID: 594
  Gene Symbol: AP2A2
  Gene Name: adaptor-related protein complex 2, alpha 2 subunit
  ENST ID: ENST00000626578
  CDS Start-End: 112-527

SEQ ID NO: 104901 - DNA, 464 bp, Homo sapiens; identical to SEQ ID NO: 104887
  Payload ID: 594
  Gene Symbol: AP2A2
  Gene Name: adaptor-related protein complex 2, alpha 2 subunit
  ENST ID: ENST00000628187
  CDS Start-End: 278-464

SEQ ID NO: 104902 - DNA, 422 bp, Homo sapiens
  Payload ID: 594
  Gene Symbol: AP2A2
  Gene Name: adaptor-related protein complex 2, alpha 2 subunit
  ENST ID: ENST00000629128
  CDS Start-End: 46-422
gccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccat

SEQ ID NO: 104903 - DNA, 422 bp, Homo sapiens; identical to SEQ ID NO: 104902
  Payload ID: 594
  Gene Symbol: AP2A2
  Gene Name: adaptor-related protein complex 2, alpha 2 subunit
  ENST ID: ENST00000630696
  CDS Start-End: 1-422

SEQ ID NO: 104904 - DNA, 4367 bp, Homo sapiens
  Payload ID: 594
  Gene Symbol: AP2A2
  Gene Name: adaptor-related protein complex 2, alpha 2 subunit
  ENST ID: ENST00000626787
  CDS Start-End: 1-2753
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggaaggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcacggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgc

SEQ ID NO: 104905 - DNA, 464 bp, Homo sapiens; identical to SEQ ID NO: 104887
  Payload ID: 594
  Gene Symbol: AP2A2
  Gene Name: adaptor-related protein complex 2, alpha 2 subunit
  ENST ID: ENST00000626063
  CDS Start-End: 278-464

SEQ ID NO: 104906 - DNA, 469 bp, Homo sapiens; identical to SEQ ID NO: 104895
  Payload ID: 594
  Gene Symbol: AP2A2
  Gene Name: adaptor-related protein complex 2, alpha 2 subunit
  ENST ID: ENST00000627987
  CDS Start-End: 1-469

SEQ ID NO: 104907 - DNA, 2883 bp, Homo sapiens
  Payload ID: 594
  Gene Symbol: AP2A2
  Gene Name: adaptor-related protein complex 2, alpha 2 subunit
  ENST ID: ENST00000627250
  CDS Start-End: 1-1904
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggctatcctgcagatgagcaccgtgtccagtgccacagcacaaggcgcctccccgccccaccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattag

SEQ ID NO: 104908 - DNA, 557 bp, Homo sapiens; identical to SEQ ID NO: 104884
  Payload ID: 594
  Gene Symbol: AP2A2
  Gene Name: adaptor-related protein complex 2, alpha 2 subunit
  ENST ID: ENST00000627507
  CDS Start-End: 377-557

SEQ ID NO: 104909 - DNA, 4367 bp, Homo sapiens
  Payload ID: 594
  Gene Symbol: AP2A2
  Gene Name: adaptor-related protein complex 2, alpha 2 subunit
  ENST ID: ENST00000629952
  CDS Start-End: 1-2753
gtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaccctgcagtgcgaggccgcctgactgagtgcctggagaccatcctgaacaaagcccaagaaccgcccaagtcgaagaaggtccagcactccaacgcgaagaatgccgtgcttttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaagactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatcctgcagatgagcaccgtatccagtgccacagcacaaggcgcctccccgccccgccgccccacacctctcccctttgggctggacgggaacacacgtgtgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgcccaccccgcctcggagcctctgggagcagcagtgccactgtgcatggcgtgggctgagccttggtgtgtggccgtcctggtggctgcacacctggcgtcgtcctgggcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggagggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcatggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgc

SEQ ID NO: 104910 - DNA, 779 bp, Homo sapiens
  Payload ID: 595
  Gene Symbol: AP2B1
  Gene Name: adaptor-related protein complex 2, beta 1 subunit
  ENST ID: ENST00000588116
  CDS Start-End: 1-495
tcagaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagtctggaaaagaactgctgtacatttttggacacctactactatacaaccccagggagctccatctgaataccagtgaccacacataaaatcgcactgatgcaggtgaca

SEQ ID NO: 104911 - DNA, 554 bp, Homo sapiens
  Payload ID: 595
  Gene Symbol: AP2B1
  Gene Name: adaptor-related protein complex 2, beta 1 subunit
  ENST ID: ENST00000590432
  CDS Start-End: 315-554
gcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaagcctcagggtacacttacaaagtagtaatagaaagcagcagatgaaggaggtgcagctctataagaaaacgtgttaagacattccagtgatgactaagcgtgctggtaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcag

SEQ ID NO: 104912 - DNA, 559 bp, Homo sapiens
  Payload ID: 595
  Gene Symbol: AP2B1
  Gene Name: adaptor-related protein complex 2, beta 1 subunit
  ENST ID: ENST00000591610
  CDS Start-End: 131-322
agacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttaggtgctgctcttctgaggtgaatttttgttatttttcttttgtttgttagcacataaagcacatttggtttttaaattgctgtcctgtgaccatctatctaaggagttggcaaacgtttttgtaaaggacaaaatagactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtct

SEQ ID NO: 104913 - DNA, 690 bp, Homo sapiens
  Payload ID: 595
  Gene Symbol: AP2B1
  Gene Name: adaptor-related protein complex 2, beta 1 subunit
  ENST ID: ENST00000587805
  CDS Start-End: 1-546
gaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaa

SEQ ID NO: 104914 - DNA, 577 bp, Homo sapiens
  Payload ID: 595
  Gene Symbol: AP2B1
  Gene Name: adaptor-related protein complex 2, beta 1 subunit
  ENST ID: ENST00000593014
  CDS Start-End: 180-577
gatagagcctggaggccgtggggggaaccgtctttcttccccgctcggcgtcgttcactgagaggctgagacgtgtccagcaagccaaagggaaaagggattccctcaaaggtttgctcattgatgggcgaacgtcgtctctcgggtaacttgagggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatga

SEQ ID NO: 104915 - DNA, 461 bp, Homo sapiens
  Payload ID: 595
  Gene Symbol: AP2B1
  Gene Name: adaptor-related protein complex 2, beta 1 subunit
  ENST ID: ENST00000592167
  CDS Start-End: 122-313
aaccgtcgggtgtgaccattgagagggaaaaggttggagaaagggtctctaccatgatgcctgtggtgcggtgagggaatcctcgggtgtggcagcaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttaggtgctgctcttctgaggtgaatttttgttatttttcttttgtttgttagcacataaagcacatttggtttttaaattgctgtcctgtgaccatctatctaaggagttggcaaacgtttttgtaaaggacaaaatattctctctttccagacgtagtgaactgtatgcagactgacaatctggaactaaagaagcttg

SEQ ID NO: 104916 - DNA, 552 bp, Homo sapiens
  Payload ID: 595
  Gene Symbol: AP2B1
  Gene Name: adaptor-related protein complex 2, beta 1 subunit
  ENST ID: ENST00000589774
  CDS Start-End: 100-552
acttttcccacaaactctctcgtgagcatgaactttttcgggaggaagagtatcagatgggtgctcagtcttaaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatc

SEQ ID NO: 104917 - DNA, 568 bp, Homo sapiens
  Payload ID: 595
  Gene Symbol: AP2B1
  Gene Name: adaptor-related protein complex 2, beta 1 subunit
  ENST ID: ENST00000590538
  CDS Start-End: 131-322
agacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttaggtgctgctcttctgaggtgaatttttgttatttttcttttgtttgttagcacataaagcacatttggtttttaaattgctgtcctgtgaccatctatctaaggagttggcaaacgtttttgtaaaggacaaaatattctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttg

SEQ ID NO: 104918 - DNA, 2266 bp, Homo sapiens
  Payload ID: 595
  Gene Symbol: AP2B1
  Gene Name: adaptor-related protein complex 2, beta 1 subunit
  ENST ID: ENST00000612116
  CDS Start-End: 236-2266
agggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggca

SEQ ID NO: 104919 - DNA, 2542 bp, Homo sapiens
  Payload ID: 595
  Gene Symbol: AP2B1
  Gene Name: adaptor-related protein complex 2, beta 1 subunit
  ENST ID: ENST00000616784
  CDS Start-End: 554-2542
ttttacgtgcagcactatcctctagccccactgcccgtatataggcctgggctatatcaccattgtccgcccttgagcctggaaggaaaatgagctgaggggttttgttttttcagaaaggaacaggatatttcatcatctctatgtttacgtttttcagagaatttctgtgcgaggaaacaaatccattgtcagctttttaaaatatatccctttggagtagccacttaacatcctctgaggcccagatgggctagcttgccgggaccaaaggaaatctttgggtctggaaggcgacaagagatcacaggctttctaggtctaccgcgcaccccgatgacgtcacgcggcgacgttctctgacgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctg

SEQ ID NO: 104920 - DNA, 2285 bp, Homo sapiens
  Payload ID: 595
  Gene Symbol: AP2B1
  Gene Name: adaptor-related protein complex 2, beta 1 subunit
  ENST ID: ENST00000614600
  CDS Start-End: 255-2285
acctgggctgtgctctccggctcccgccgccacccccgccctcgccttcgcctccgcctccggtgagttcagggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggca

SEQ ID NO: 104921 - DNA, 3428 bp, Homo sapiens
  Payload ID: 595
  Gene Symbol: AP2B1
  Gene Name: adaptor-related protein complex 2, beta 1 subunit
  ENST ID: ENST00000620039
  CDS Start-End: 139-288
agtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagcacataaagcacatttggtttttaaattgctgtcctgtgaccatctatctaaggagttggcaaacgtttttgtaaaggacaaaatattctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaa

SEQ ID NO: 104922 - DNA, 2055 bp, Homo sapiens
  Payload ID: 595
  Gene Symbol: AP2B1
  Gene Name: adaptor-related protein complex 2, beta 1 subunit
  ENST ID: ENST00000621668
  CDS Start-End: 139-2055
agtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggca

SEQ ID NO: 104923 - DNA, 5702 bp, Homo sapiens
  Payload ID: 595
  Gene Symbol: AP2B1
  Gene Name: adaptor-related protein complex 2, beta 1 subunit
  Uniprot ID: P63010
  ENST ID: ENST00000621914
  CDS Start-End: 179-2992
ctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacac

SEQ ID NO: 104924 - DNA, 2161 bp, Homo sapiens
  Payload ID: 595
  Gene Symbol: AP2B1
  Gene Name: adaptor-related protein complex 2, beta 1 subunit
  ENST ID: ENST00000612035
  CDS Start-End: 131-2161
agacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggca

SEQ ID NO: 104925 - DNA, 3415 bp, Homo sapiens
  Payload ID: 595
  Gene Symbol: AP2B1
  Gene Name: adaptor-related protein complex 2, beta 1 subunit
  Uniprot ID: P63010
  ENST ID: ENST00000618940
  CDS Start-End: 173-3028
gaccggcggaggcgaggaaatcctaagagcgtgaccgttgatgatgcagggaaccgtcgggtgtgaccattgagagggaaaaggttggagaaagggtctctaccatgatgcctgtggtgcggtgagggaatcctcgggtgtggcagcaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactg

SEQ ID NO: 104926 - DNA, 3204 bp, Homo sapiens
  Payload ID: 595
  Gene Symbol: AP2B1
  Gene Name: adaptor-related protein complex 2, beta 1 subunit
  Uniprot ID: P63010
  ENST ID: ENST00000610402
  CDS Start-End: 131-2986
agacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctc

SEQ ID NO: 104927 - DNA, 3267 bp, Homo sapiens
  Payload ID: 595
  Gene Symbol: AP2B1
  Gene Name: adaptor-related protein complex 2, beta 1 subunit
  ENST ID: ENST00000616681
  CDS Start-End: 139-2880
agtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactg

SEQ ID NO: 104928 - DNA, 192 bp, Homo sapiens
  Payload ID: 595
  Gene Symbol: AP2B1
  Gene Name: adaptor-related protein complex 2, beta 1 subunit
  ENST ID: ENST00000628168
  CDS Start-End: 1-192
atgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttaggtgctgctcttctgaggtgaatttttgttatttttcttttgtttgttag

SEQ ID NO: 104929 - DNA, 1931 bp, Homo sapiens
  Payload ID: 596
  Gene Symbol: AP2M1
  Gene Name: adaptor-related protein complex 2, mu 1 subunit
  Uniprot ID: Q96CW1
  ENST ID: ENST00000292807
  CDS Start-End: 149-1456
actgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 104930 - DNA, 2091 bp, Homo sapiens
  Payload ID: 596
  Gene Symbol: AP2M1
  Gene Name: adaptor-related protein complex 2, mu 1 subunit
  Uniprot ID: Q96CW1
  ENST ID: ENST00000382456
  CDS Start-End: 315-1616
cttcctgaggcgggggcggtttctcgaaggcagtcggtagttgtagttttgctaaacctagagcgcttcaaattgcaagcaaggaggccgcgaggcctgacgggatttgtagtcggcgctagacgccggcgcgcacgcgcagccggggccggggcggggcggcggcactgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtgga

SEQ ID NO: 104931 - DNA, 802 bp, Homo sapiens
  Payload ID: 596
  Gene Symbol: AP2M1
  Gene Name: adaptor-related protein complex 2, mu 1 subunit
  ENST ID: ENST00000432591
  CDS Start-End: 46-802
aggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgagga

SEQ ID NO: 104932 - DNA, 557 bp, Homo sapiens
  Payload ID: 596
  Gene Symbol: AP2M1
  Gene Name: adaptor-related protein complex 2, mu 1 subunit
  ENST ID: ENST00000427072
  CDS Start-End: 149-557
actgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggagtcgtcaggctgctgactcagctgtcttcagttcctctggcccattccctggggagtggctggaagcgaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatg

SEQ ID NO: 104933 - DNA, 601 bp, Homo sapiens
  Payload ID: 596
  Gene Symbol: AP2M1
  Gene Name: adaptor-related protein complex 2, mu 1 subunit
  ENST ID: ENST00000448139
  CDS Start-End: 122-601
agacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcggcaataggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcag

SEQ ID NO: 104934 - DNA, 1577 bp, Homo sapiens
  Payload ID: 596
  Gene Symbol: AP2M1
  Gene Name: adaptor-related protein complex 2, mu 1 subunit
  ENST ID: ENST00000411763
  CDS Start-End: 149-1531
actgcggtgaaagccgaggcagcgggcagacgagcagggggcgggcggacatcttgggatccggagagtggccgggccggcagagcagggggccgaggacaccaggtctgttctcagagcgatgggccgcggagactgatctgccgccatgattggaggcttattcatctataatcacaagggggaggtgctcatctcccgagtctaccgagatgacatcgggagtcgtcaggctgctgactcagctgtcttcagttcctctggcccattccctggggagtggctggaagccaataggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccaca

SEQ ID NO: 104935 - DNA, 545 bp, Homo sapiens
  Payload ID: 596
  Gene Symbol: AP2M1
  Gene Name: adaptor-related protein complex 2, mu 1 subunit
  ENST ID: ENST00000455925
  CDS Start-End: 206-545
gaggacaccaggtgagccggggatctggccttatggcgtggaggaggacgctgcgggtcgtctgcctcgccgcgcagctttgtcctgccctgcactgagctggcggaaagctgcccacacccgggagtggcttcagccttcggacccgggagctagctgacggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatg

SEQ ID NO: 104936 - DNA, 602 bp, Homo sapiens
  Payload ID: 596
  Gene Symbol: AP2M1
  Gene Name: adaptor-related protein complex 2, mu 1 subunit
  ENST ID: ENST00000431779
  CDS Start-End: 16-602
gactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatcaggtaagctcttccctcagcttccacccttgcagctttgctttgtttctccaggccctgccctttggggcttataggggaaaatggattacagacaaaagaagagcagtcacagatcaccagccaggtaactgggcagattggctggcggcgagagggta

SEQ ID NO: 104937 - DNA, 1950 bp, Homo sapiens
  Payload ID: 596
  Gene Symbol: AP2M1
  Gene Name: adaptor-related protein complex 2, mu 1 subunit
  Uniprot ID: Q96CW1
  ENST ID: ENST00000439647
  CDS Start-End: 217-1518
ggaataaacaggaactggagcctggctgaggggaggggcatgtctgggagggctgcagggtcacttactaaagggttgagtcaggaaagaagctccagtgacctgcacagctccacaggggatgttggcagcgattctgaggtcttcttttaccctgcccccgcctgtcctaggtctgttctcagagcgatgggccgcggagactgatctgccgccatgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtg

SEQ ID NO: 104938 - DNA, 673 bp, Homo sapiens
  Payload ID: 596
  Gene Symbol: AP2M1
  Gene Name: adaptor-related protein complex 2, mu 1 subunit
  ENST ID: ENST00000442686
  CDS Start-End: 1-369
tttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtatggcagaggaggggcctagagtcatgccagggtatgctggaagacctcttagagatcattccgataaactgctgcaccttagaggtgaggaaactgaggcctagaaagaagaactggctttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtg

SEQ ID NO: 104939 - DNA, 1305 bp, Homo sapiens
  Payload ID: 596
  Gene Symbol: AP2M1
  Gene Name: adaptor-related protein complex 2, mu 1 subunit
  ENST ID: ENST00000621863
  CDS Start-End: 1-1305
atgattggaggcttattcatctataatcacaagggggaggtgctcatctcccgagtctaccgagatgacatcgggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatgagattctagactttggctacccacagaattccgagacaggcgcgctgaaaaccttcatcacgcagcagggcatcaagagtcagcatacaaaagaagagcagtcacagatcaccagccaggtaactgggcagattggctggcggcgagagggtatcaagtatcgtcggaatgagctcttcctggatgtgctggagagtgtgaacctgctcatgtccccacaagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagagcgggaagcaatcaattgccattgatgactgcaccttccaccagtgtgtgcgactcagcaagtttgactctgaacgcagcatcagctttatcccgccagatggagagtttgagcttatgaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggatcccaaccccactgaacacaagcggggtgcaggtgatctgcatgaaggggaaggccaagtacaaggccagcgagaatgccatcgtgtggaagatcaagcgcatggcaggcatgaaggaatcgcagatcagcgcagagattgagcttctgcctaccaacgacaagaagaaatgggctcgaccccccatttccatgaactttgaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctag

SEQ ID NO: 104940 - DNA, 935 bp, Homo sapiens
  Payload ID: 597
  Gene Symbol: AP2S1
  Gene Name: adaptor-related protein complex 2, sigma 1 subunit
  Uniprot ID: P53680
  ENST ID: ENST00000263270
  CDS Start-End: 227-655
atctgactcgtttggtaggaaaaggactggctctgactcttcacccatcttcacccaggctggcccctttggtgaaactacaactcccaggggtctgtgcgcgagaaggcaggcgggtttttctaccggaagtccgctctagctctgggccctacaactgcaccctgagccggagctgcccagtcgccgcgggaccggggccgctggggtctggacgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggc

SEQ ID NO: 104941 - DNA, 793 bp, Homo sapiens
  Payload ID: 597
  Gene Symbol: AP2S1
  Gene Name: adaptor-related protein complex 2, sigma 1 subunit
  ENST ID: ENST00000352203
  CDS Start-End: 12-482
cgggggtcgccatgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcctggcaatctccgttgctgacagcctctctgttctgcagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtctttgagcccttgcctgtctccc

SEQ ID NO: 104942 - DNA, 898 bp, Homo sapiens
  Payload ID: 597
  Gene Symbol: AP2S1
  Gene Name: adaptor-related protein complex 2, sigma 1 subunit
  ENST ID: ENST00000601498
  CDS Start-End: 133-609
gtctctagagacaaggatctgattgcaggtggagaggggatgttgagacaggggcaggagactgcctgtgagagagggatgatctcaagaagagacctggcacaggaaaccaaaaggaggcaactgtagggaatgaaacttaagggtctgggaaagcgctgtaaaaggagagaggacctggagatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtc

SEQ ID NO: 104943 - DNA, 707 bp, Homo sapiens
  Payload ID: 597
  Gene Symbol: AP2S1
  Gene Name: adaptor-related protein complex 2, sigma 1 subunit
  ENST ID: ENST00000597020
  CDS Start-End: 64-432
ccccagatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgc

SEQ ID NO: 104944 - DNA, 315 bp, Homo sapiens
  Payload ID: 597
  Gene Symbol: AP2S1
  Gene Name: adaptor-related protein complex 2, sigma 1 subunit
  Uniprot ID: P53680
  ENST ID: ENST00000601649
  CDS Start-End: 1-315
atgatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 104945 - DNA, 829 bp, Homo sapiens
  Payload ID: 597
  Gene Symbol: AP2S1
  Gene Name: adaptor-related protein complex 2, sigma 1 subunit
  ENST ID: ENST00000599990
  CDS Start-End: 106-540
gccatggtaacgggggagcgctacgccggggactggcggagggggggcccacgcgtaaatagccgaggctggatcgggcgctgacaagtcccttctctgccgcggatggtctggatccgctttatcctcatccagaaccgggcaggcaagacgcgcctggccaagtggtacatgcagtttgatgatgatgagaaacagaagctgatcgaggaggtgcatgccgtggtcaccgtccgagacgccaaacacaccaactttgtggagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtc

SEQ ID NO: 104946 - DNA, 636 bp, Homo sapiens
  Payload ID: 597
  Gene Symbol: AP2S1
  Gene Name: adaptor-related protein complex 2, sigma 1 subunit
  ENST ID: ENST00000593442
  CDS Start-End: 69-347
tgcaccctgagccggagctgcccagtcgccgcgggaccggggccgctggggtctggacgggggtcgccatgttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtgagggcaggcgagccccaccccggccccggcccctcctggactcgcctgctcgcttccccttcccaggcccgtggccaacccagcagtccttccctcagctgcctaggaggaagggacccagctgggtctgggccacaagggaggagactgcaccccactgcctctgggccctggctgtgggcagaggccaccgtgtgtgtcccgagtaaccgtgccgttgtcgtgtgatgccataagcgtctgtgcgtggagtccccaataaacctgtggtcctgcctggccttgccgtc

SEQ ID NO: 104947 - DNA, 5838 bp, Homo sapiens
  Payload ID: 598
  Gene Symbol: AP3B1
  Gene Name: adaptor-related protein complex 3, beta 1 subunit
  Uniprot ID: O00203
  ENST ID: ENST00000255194
  CDS Start-End: 177-3461
actgcgcatgcgcagggggtggactgccaggtcggctcagggagccgtgacgagtccggaagcgcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaatagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgtaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcatatttgtctttgcatttttaatgagaaactattaataatcctgaagttcatatgctaaagttttcttattttaaagcaagtattttgagtgttacattatgcagagaagcaatgtggtttagttagcgaaagaaaaaccacttccaaaccaagtaaattttctacttatagtttactccaaggaaaaaaaattggtgtatttaataacaaaaacaaaaatcttcatattgcaaaataaacatcttctaggtagttttgatctattagtagatatctgattatgtggcctgctgaataaattctttgaatctcatttttccttatgcccaactttggaaactaactagcataaacttatagaaatgtttaaaactagttatatgatcaacctattagcatcttttcctagagtatttgttttatttgctaccttaagttactgttttcaaggttgttctataatcagagaacttttctaatactttcgtacctttttaaaaccagctgaaattttacttcctttttgaagcaaggtaatggactttcaggtagtataagctactcagttctttttgtatagagccacatacataatgatttttaaaaagtaaaaaggaagtgactgtacattgcttgaagcattataggaaggctgaaaagaaaagaatggaattttcttggaacatacatattgaaaagaacaaaacagagtcgaaaaattatttaaattttcaagctggtgggatgacaagagtaaacaaaattgttaaattttcctgctccagaaagaaatatagccctgaatctccgggaagagaatgtacagaagtgcaatgtacagaagccacgtgtacattttgtgccaattccgtaccatgtgtacattctgtaccattctgtaccaatgtatggaagccacgagttccacttccctctggagcctgggcgctgtggtaacacacccaaaagcccctttgtaatcgcaggtcgttggcatttccatattagccttattgctcagagcttcataactttgaattttaagtcaataactttttgaaatgtcagacagaatttgacaggtttaatacctgttttctgaggaagaaaaaaaaattatatccatgctgtcttcaggcagagggaaagtgcatgttgtgattgagaaaggtcttatttttccttaaattaggacactcatctttaaaagatagttcacacatttgtatttttttaaactaaggaaatttaattagggctttacttttgactaagttatttttggctgctaacttttaaaattatggtaaatcaataatataatgtagtatgaatcagtgaacagtatgtatcgattgtaatgtgcgctaccagttgaaaccattttaacactagtagcttaatatcattaaaatgtttttcacgtaaaacagaaaaacgaccaaagccccaagttaaaggtttggttttttttcttttgtggtgtggtgattcagagttccttgcctcatatttcctttaactttgtcataatccatgattatctttaaattgttccattgagtcgagttagtcaatgttgaattcttaattctagctatattttttcattttaatgttcacttaatgggacattttatgtacaccaatcttgaagaatggctctcatagtatatttcagactaagcctcatttttgatatcacaatacatttgctttatttattatgagagtttttttattctaaagagactgtaacaatgcatttctcaaattaaaatactgtatacttgtccttctcga

SEQ ID NO: 104948 - DNA, 1170 bp, Homo sapiens
  Payload ID: 598
  Gene Symbol: AP3B1
  Gene Name: adaptor-related protein complex 3, beta 1 subunit
  ENST ID: ENST00000522901
  CDS Start-End: 1-464
ctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtctctcttttttctcttccaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagc

SEQ ID NO: 104949 - DNA, 3986 bp, Homo sapiens
  Payload ID: 598
  Gene Symbol: AP3B1
  Gene Name: adaptor-related protein complex 3, beta 1 subunit
  Uniprot ID: O00203
  ENST ID: ENST00000519295
  CDS Start-End: 273-3410
gcctgcgcgcgctcctccgtacgagaactagttttgttccgtgccctctggactggaaccttttggagagaacccccggcaggaccaaccccgcacccgccagcaccgcggcaatgtccagcaatagttttccttacaatgagcagtccggaggaggggaggcgacggagctgggtcaggaggcgacctcaaccatttccccctcgggggccttcggcctctttagcagcgatttgaagaagtgaggagaaaggaatgaagatctaaagcaaatgttagagagcaacaaagattctgctaaactggatgctatgaagcggattgttgggatgattgcaaaagggaaaaatgcatctgaactgtttcctgctgttgtgaagaatgtggccagtaaaaatattgagatcaagaagttggtatatgtttacctggttcgatatgctgaagaacagcaggatcttgcactcctgtccataagcacttttcagcgagctctgaaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacagccttgatccagagcagaaggaaatgttaattgaagtaattgaaaaacttctgaaagataaaagcacattggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtggttatggcagttgctcagctgtattggcacatatcaccaaaatctgaagctggcataatttctaaatcactagtgcgtttacttcgtagcaatagggaggtgcagtatattgtcctacaaaatatagcaactatgtcaattcaaagaaaggggatgtttgaaccttatctgaagagtttctatgttaggtcaactgatccaactatgatcaagacactgaagcttgaaattttgacaaacttggcaaatgaagccaacatatcaactcttcttcgagaatttcagacctatgtgaaaagccaggataaacaatttgcagcagccactattcagactataggcagatgtgcaaccaacatcttggaagtcactgacacgtgcctcaatggcttggtctgtctgctgtccaacagggatgaaatagttgttgctgaaagtgtggttgttataaagaaattactgcaaatgcaacctgcacaacatggtgaaattattaaacatatggccaaactcctggacagtatcactgttcctgttgctagagcaagtattctttggctaattggagaaaactgtgaacgagttcctaaaattgcccctgatgttttgaggaagatggctaaaagcttcactagtgaagatgatctggtaaaactgcagatattaaatctgggagcaaaattgtatttaaccaactccaaacagacaaaattgcttacccagtacatattaaatctcggcaagtatgatcaaaactacgacatcagagaccgtacaagatttattaggcagcttattgttccgaatgtaaagagtggagctttaagtaaatatgccaaaaaaatattcctagcacaaaagcctgcaccactgcttgagtctccttttaaagatagagatcatttccagcttggcaccttatctcatactctcaacattaaagctactgggtacctggaattatctaattggccagaggtggcgcccgacccatcagttcgaaatgtagaagtaatagagttggcaaaagaatggaccccagcaggaaaagcaaagcaagagaattctgctaagaagttttattctgaatctgaggaagaggaggactcttctgatagtagcagtgacagtgagagtgaatctggaagtgaaagtggagaacaaggcgaaagtggggaggaaggagacagcaatgaggacagcagtgaggactcctccagtgagcaggacagtgagagtggacgggagtcaggcctagaaaacaaaagaacagccaagaggaactcaaaagccaaaggaaaaagtgattctgaagatggggagaaggaaaatgaaaaatctaaaacttcagattcttcaaatgacgaatctagttcaatagaagacagttcttccgattctgaatcagagtcagaacctgaaagtgaatctgaatccagaagagtcactaaggagaaagaaaagaaaacaaagcaagatagaactcctcttaccaaagatgtttcacttctagatctggatgattttaacccagtatccactccagttgcacttcccacaccagctctttctccaagtttgatggctgatcttgaaggtttacacttgtcaacttcctcttcagtcatcagtgtcagtactcctgcatttgtaccaacgaaaactcacgtgctgcttcatcgaatgagtggaaaaggactagctgcccattatttctttccaagacagccttgcatttttggtgataagatggtctctatacaaataacactgaataacactactgatcgaaagatagaaaatatccacataggggaaaaaaaacttcctataggcatgaaaatgcatgtttttaatccaatagactctcttgagcctgagggatccattacagtttcaatgggtattgacttttgtgattctactcagactgccagtttccagttgtgtaccaaggatgattgcttcaatgttaatattcagccacctgttggagaactgcttttacctgtggccatgtcagagaaagattttaagaaagagcaaggagtgctaacaggaatgaatgaaacttctgctgtaatcattgctgcaccacagaatttcactccctctgtgatctttcagaaggttgtaaatgtagccaatgtaggtgcagtcccttctggccaggataatatacacaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcata

SEQ ID NO: 104950 - DNA, 3736 bp, Homo sapiens
  Payload ID: 599
  Gene Symbol: AP3B2
  Gene Name: adaptor-related protein complex 3, beta 2 subunit
  Uniprot ID: Q13367
  ENST ID: ENST00000261722
  CDS Start-End: 209-3457
gcgccggtgcctttaagacctcagcgcgcggccctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctcta

SEQ ID NO: 104951 - DNA, 3254 bp, Homo sapiens
  Payload ID: 599
  Gene Symbol: AP3B2
  Gene Name: adaptor-related protein complex 3, beta 2 subunit
  Uniprot ID: Q13367
  ENST ID: ENST00000535348
  CDS Start-End: 74-3226
ccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctc

SEQ ID NO: 104952 - DNA, 3921 bp, Homo sapiens
  Payload ID: 599
  Gene Symbol: AP3B2
  Gene Name: adaptor-related protein complex 3, beta 2 subunit
  ENST ID: ENST00000542200
  CDS Start-End: 154-579
gcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggagcctgtggtaatggctgcttctagtatgaaccacttgagcccccggagagtggagagtctctagcaatggagaacccctcaaccctcacccccctttgtgtaaaggtgtgaattgtggtccacagccaggtagatttcaacctttagcagtggcctgaatcccccacaccattctcaccttttgtttcattttgcccaaggcctctagttggatttacatatgttaggtgcatgtataagtctcccccctaagggcttttctggttagtctaagacatcttgagggtaaagacagccatttcaaggccattctctccatattggatttttcagctctgattacaaccattaactcctctatttttgcatacctttatttatttatttatttatgagacaggttctcactgtgttgcccaggctggagtgcagtggtgcaatcatggctcactggagcctcgacttccctgagctcaggtgattctcccacctctgtctcctgagtagctgcgactactcagcctgcatcaccatgctcggctaatttttttgtagtttttgtagagatggggtttcaccctgttgcctatgctggtcttggactcctgggctcaagtggcctcagcttcccaaagtgctgggattacagggatgagctaatactcctagcctggatacttttagttcaaatttctgtgagagagattgtgaaaggtccagctcatcttttcatatccagaagttctgtaggttgctgggtagacaggattgctgctcaaatccagggcccaccccttgtccaatctgctatggccagcaagaggggttgacagtcggcttctttggggtgagagtagaaagcatggtcacttgaatatacaattcattcatttagtaaatacttgggtgtctctatgccacacattgtgctagatttctttttataagtcaaaaccatggaatccgtcttagattggcaagtaatcttttggtttgagtaagggttaagtataaaaactaatctgaaattgttgtacagattttcacctatagtctctaccaactgaccctgtcccccttttagaaaaccagagctcatttagttcaactcaatgtgataatttctttctgcaaagtgccaaatagtattttaggttttgtaggccttatagtctcaactatgcaactactcaattttgcccttatggtgcaaatgcagccattgacaagtgggcgtggccgtgttccaataaatctatataaaaaacaggcaatagacagattttatccaagggctgtagcatgccagcctttgctctagaacatgtctaacaggtcatcttttctgatagggacctcactccttcataaggcaacttgctccatctcaagacaactaccactatttggggtgttttttaaaccattctcttttgttgaaacctccacaactataatttttaaaaattgatttcaggctgggtgtggtggctcatgcctgtaatcccagcactttgggaggccgaagcaggcaaatcacaaggtcaggagttcaagaccagcctggccaacatggtgaaactccatctctactaaaaatacaaaaaattagcttggcatggtggcgggtgcccataatcccagctactcaggaggctgacgcaggagaatggcttgaacccgggaggcagaggttgcaatgagccgagaacgtgccactgcagtccagcccaggcgacagtgtgagatccatctcaaaaaaaaaaaaaattgatttcaggctgtactgcattatgactgcacctgtgaatagccactgtactccagcctgggcaacatagggagaccctgtatctaaaaaataaaataaaatttactacaggttcacaaaaggcataaagaataatataatgaatatccataagaaatgacacatttctcaaatagccaaagcctcctatatatcttctcttgtttatcattcataggtatgtatttattcctgtgctagtaatttgcatattgttaagcaatataaaatgttttgtaaatggtgtcatcgtactacatatgtattcctttaaaacttgttttcttttttgttgtcactggcttttggtctctcctgcatgttggaaccaatcatttcaatccagccttctcccttctttcaatcctagcccaggctagggccgtgttcactttcttaggagatccctcatggaatcaaacctctgactggcaagcagataatccaggtctccctacatcctgtctttgtacagttggtcccttgaaccccctatgaaaccctactctatttcattttatcagtttagcacagggtccaaaccagggtgattctgaatcttaattatgtccctcctgattttgtgtcttctttcaagatactgataagctatttggaccagggcaaaagactgaggcatagcatgtttccaggttgacactgatctgttaataaaccttctccaagtatatttcaccacgttgtagacccacctgactgtacagacagctggcatttttctatcttgttaggaaggatcttattcaatagcaataaataaataaataaataacacctttcatgtgcaaagggttgtgggtgacacagagataaaacagatgtgaattctgctcttaaaaatgcttggctattaggtgaaacaaaaggcctacctaaaaaatagcaatgcaggaaatgctatgagacttccacaaacatatcactgaaatcaagatactaatatccaccggcctagttaccccatcaaaaaggaaaacacattttttttgataactttctgtgaatctataatcatttcccaaataaaatgctcacacacaaaaaaggaaaacaggtttaagcagatgatgtgactatttgtctctaagaaaacagagactccttccttttcaataaatgtttctaacccatctgtttaaaagtcaattccagaattttgtcaggaattagcatcaattttacctgcaattgtgaggatcttgtcttgtctttttccatttcagaaagtcagggtaatatctacccttctttagtgttctattcccgtcattctctaagagtaatagtacaggcacacctcattgtattgcactttgcagatattgccagatattgcactttttacaaattgagggtttgtggcaaccctacatcaatcaagtctatcagtgccatttttccaacagtatgtgctcacattgtgcctctgtcacattctggtaattctcacaatattccaaactttttaatgattattatatgttatggtgatcagtgatctttgatgttactattgtaattgttttggggtgccacaaaccatgctcagacatgaaagtgaaattaatcaataaa

SEQ ID NO: 104953 - DNA, 3402 bp, Homo sapiens
  Payload ID: 599
  Gene Symbol: AP3B2
  Gene Name: adaptor-related protein complex 3, beta 2 subunit
  Uniprot ID: Q13367
  ENST ID: ENST00000535359
  CDS Start-End: 74-3379
ccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggaagaagatctctcccttattgagactcacgtgggcctgttgggcgaatacactgaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgttt

SEQ ID NO: 104954 - DNA, 746 bp, Homo sapiens
  Payload ID: 599
  Gene Symbol: AP3B2
  Gene Name: adaptor-related protein complex 3, beta 2 subunit
  ENST ID: ENST00000541693
  CDS Start-End: 168-746
tgacagcgaggtgtatatcaagggaggccctcggtgctgcccacgcctacccagctcaatggtctgtacctatgaccatgcccctggtgtcctgagctcagcctcctacccactaagaaactcaacagtctggtctgtgtttggcagggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtg

SEQ ID NO: 104955 - DNA, 247 bp, Homo sapiens
  Payload ID: 599
  Gene Symbol: AP3B2
  Gene Name: adaptor-related protein complex 3, beta 2 subunit
  ENST ID: ENST00000538592
  CDS Start-End: 1-69
atctccctgcttgatctagaggattgctccctgctcaacccaagccacctccactttgcctcctcatagtcttatctactcccacagtcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagc

SEQ ID NO: 104956 - DNA, 3729 bp, Homo sapiens
  Payload ID: 599
  Gene Symbol: AP3B2
  Gene Name: adaptor-related protein complex 3, beta 2 subunit
  Uniprot ID: Q13367
  ENST ID: ENST00000620652
  CDS Start-End: 203-3451
gtgcctttaagacctcagcgcgcggccctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctct

SEQ ID NO: 104957 - DNA, 4870 bp, Homo sapiens
  Payload ID: 600
  Gene Symbol: AP3D1
  Gene Name: adaptor-related protein complex 3, delta 1 subunit
  Uniprot ID: O14617
  ENST ID: ENST00000345016
  CDS Start-End: 224-3685
ttgtccgccatttgcaaggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggcatttcca

SEQ ID NO: 104958 - DNA, 5034 bp, Homo sapiens
  Payload ID: 600
  Gene Symbol: AP3D1
  Gene Name: adaptor-related protein complex 3, delta 1 subunit
  Uniprot ID: O14617
  ENST ID: ENST00000355272
  CDS Start-End: 208-3855
aggggcccggagcgggatcgcggcacctgccgagcgggtcgccgcctctgccgcggtccttggaccccgccgccgccctggcctgggagcttgccccgccgcagcggccggcagcgcggcgctccgcgggcggcaggcacgggccccgggccccctcacggcgcccagccgcgggcctcccgaggcaaaagcccgtgggccgccgcgatggccctcaagatggtgaagggcagcatcgaccgcatgttcgacaagaatctgcaggacttggtccgcggcatccgtaaccacaaggaggacgaggcaaaatacatatctcagtgcattgatgagatcaagcaggagctgaagcaggacaacatagcggtgaaggcgaacgcggtctgcaagctgacgtatttacagatgttgggatacgacatcagctgggccgccttcaacatcatagaagtgatgagtgcctccaagttcaccttcaagcgaattggctacctcgctgcttcccagagctttcacgaaggcaccgacgtcatcatgctgaccaccaatcagatccgtaaggacttgagcagccccagccagtacgacacaggtgttgcactgacgggtctgtcctgcttcgtcaccccagaccttgccagagacctggcaaatgacatcatgacactgatgtcacacaccaagccctacatcaggaagaaggctgtgctgatcatgtacaaggtgttcctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagcacgtctgccatgtctctcctctatgaatgtgtgaacaccgtgattgcagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacacggcacggccacctcatcgccgcccaaatgctggacgtggccatccgcgtgaaggccatccgcaagttcgccgtgtcccagatgtctgcgctgcttgacagtgcacacctgctggccagcagcacccagcggaacgggatctgtgaggtgctgtacgctgccgcctggatctgcggggagttctcagagcatctgcaggaaccacaccacactttggaggccatgctgcggcccagagtcaccacgctgccaggccacatccaggccgtgtatgtgcagaacgtggtcaagctctacgcctccatcctgcagcagaaggagcaggccggggaggcagagggcgctcaggccgtcacccagctcatggtggaccggctgccccagtttgtgcagagcgcagacctggaggtgcaggagcgggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaaggcctggacctggacgcctggatcaatgagccactctcggacagcgagtcagaggacgagaggcccagggccgtcttccacgaggaggagcagcggcgtcccaagcaccggccgtcggaggcggacgaggaagagctggctcggcgccgagaggcccggaagcaggagcaggccaacaaccccttctacatcaagagctcgccatcgccacagaagcggtaccaggacaccccgggcgtggagcacattcccgtggtgcagattgacctctccgtccccttgaaggttccagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgagaatgctctgcccagcgacgaggatgacaaagaccccaacgacccctacagggctctggatattgacctggataagcccttagccgacagcgagaaactgcctattcagaaacacagaaacaccgagacctcaaaatcccctgagaaggacgttcccatggtagaaaagaagagcaagaaacccaagaagaaagagaaaaaacacaaagagaaagagagagacaaggagaagaagaaggagaaggagaagaaggctgaggacctggacttctggctgtctaccaccccaccgcctgcccccgcccccgcccccgcccccgttccatccacgggggagctcagtgtgaacactgtcactaccccgaaggacgagtgtgaggacgccaagacggaggcgcagggcgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggaggcagcgggggagccggtgcagaatggcgcgccagaggaggagcagctcccgcctgagtccagctactccctcctcgctgaaaattcctatgttaaaatgacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtccattgtcagtgtgctcgtgggctggtgactgggtcttgggatcccaggccacgcgccagccaggctgtgggcagggcggggccagggacgccaaagagaggttgcagtcagaaccgtggacggggtgggttgaggcctctctgccacccgtcttcctggtcagcagaagtgcatctcggcttgggtttggggtggtccgcatcccctgcttgccactatgcgcaccaaggtttccccacatccttcccagcacccttaggaaggcccaggcagggcctggaagcagcggacctgggctgttctgtgttgaaggagtgtgcccagtgcccttgggcaggacctgtgagagccacctcacaggcagagcccccaccaggcagggcaaggagactccgctcactccccacggccagcgtgggcacaggactgacccttcttcagagataatgacattttatcttctccttttgatgaaaactgtcactttagcatgtaatccattacagaatcccatgcagtgattccaggatttgaaattgtatgatgtgttacataagaatttatttgctatcgacattcccgtataaagagagagacatatcacgctgctgtcatgattttgtgtcaagatgatccaataaagttgtaaaacaggca

SEQ ID NO: 104959 - DNA, 618 bp, Homo sapiens
  Payload ID: 600
  Gene Symbol: AP3D1
  Gene Name: adaptor-related protein complex 3, delta 1 subunit
  ENST ID: ENST00000589369
  CDS Start-End: 1-581
tggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagtgacgcctttgctaagttgctggagtctggggacttgagcatgagctcaatcaaagtcgatggcattcggatgtccttccagaatcttctggcgaagatctgttttcaccaccatttttccggcctcctgaagctgtggccaagggcagcccaagaaggtggcccctgctctgggggtggggctgcagccatgcaatgtccgggaagcctaacactgcccgctctgttgcagttgtggagcgagtggactcctgcgcctccatgtacagccgctccatccagggccaccatgtctgcctcctggtgaaaaagggtgagaactctgtctcagtcgacgggaagtg

SEQ ID NO: 104960 - DNA, 911 bp, Homo sapiens
  Payload ID: 600
  Gene Symbol: AP3D1
  Gene Name: adaptor-related protein complex 3, delta 1 subunit
  ENST ID: ENST00000586370
  CDS Start-End: 1-466
gggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggcgtctccaacgaagcccagtatgtgttcaccatccagagcatcgtcatggcgcagaagctcaaggggaccctgtccttcattgccaagaatgacgagggtgcgacccacgagaagctggacttcaggctgcacttcagctgcagctcctacttgatcaccactccctgctacagaatcttctggcgaagatctgttttcaccaccatttttccgttgtggagcgagtggactcctgcgcctccatgtacagccgctccatccagggccaccatgtctgcctcctggtgaaaaagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggc

SEQ ID NO: 104961 - DNA, 723 bp, Homo sapiens
  Payload ID: 600
  Gene Symbol: AP3D1
  Gene Name: adaptor-related protein complex 3, delta 1 subunit
  ENST ID: ENST00000590683
  CDS Start-End: 1-610
cctgaagtaccccgagtcgctgcgccctgcctttccccggctgaaggagaagctggaggaccccgaccccggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctgttcggtgctcttactcctttggaaccgcggctgggcaagaagctgatcgagcccctcaccaatctcatccacagtgctcatctcgctgtcctccggcatgcccaaccacagcgccagcatccagctttgtgttcagaaattaaggatattgatcgaggactccgatcagaacttgaagtacctggggctgctggcaatgtccaagatcctgaagacccaccccaagtccgtgcagtcccacaaggacctcatcctgcagtgcctggacgacaaggacgagtccatccggctgcgggccctggacctgctctatgggatggtgtccaagaagaacctgatggagatcgtgaagaagctgatgacccacgtagacaaggcagagggtaccacctaccgtgacgagctgctcaccaagatcattgacatctgcagccagtccaactaccagtacatcaccaacttcgagtggtacatcagcatcctggtggagctgacccggctggagggcacac

SEQ ID NO: 104962 - DNA, 5124 bp, Homo sapiens
  Payload ID: 601
  Gene Symbol: AP3M1
  Gene Name: adaptor-related protein complex 3, mu 1 subunit
  Uniprot ID: Q9Y2T2
  ENST ID: ENST00000355264
  CDS Start-End: 313-1569
gggaccccagactgcgttaggcagcagatgaccgcctgaatctagatggagagaaacccaccatttttctaggccctggattatgtagaagatttagatactaagcctcaagagacgtctttcctctcatttacggtcttcctgcatatttaaaatttctaatacggtagacagagtcggtgtctttgaagctgttaatcaggcaatttcctgggcactccagctgcgggtcctcgcggccttctcggcttctccagcttcggtaggagaggatccggcgccgaatcactgactggcacaggtgttgggaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccgagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaagaaaaacttaagtgaaacctttgccatcttcatgttttataatataaagcttacccaacaccagttaagccatggttaacctaaatgcctcatgccccagttcagcaaaaggaggaaaatgtgcctgcctcacagtcatcagtctttttaaatcttttttgttgttgttcttaagggtttgaatttgtctgcattccttgtctttaggggaaattcccttttcatattgtgtgcttcccaaagctatagtcatagatttcttccagaaactattgtcataattgtcactggagtgcttaaatatacgtactatactgacaaaatacatggaagtgagttataatgaggcagaaacaaaatcctcggtaacattgatgatactctaccgatcaccgtggttttggaaagtcagtcaacagttgtattattgcactcaatttcattgtgacattttatttaacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcctttcatggaataagaaaggcaacgttttgcagcttccaaatttctgaagaaactaatctcagattggcagttaaagtcaaaatgttgccaaatatttattccttttgcctaagtttggctacccggttcaattgctttttatttttaatgtcttgactcttcagagttcgtacctcaaaagaacaatgagaacatttgctttgctttctgctgaatccctaatctcaacaatctatacctggactgtccagttctcctcctgtgctatcttctcttctatccaagtagaatgtacgccaggagctccttccctctagcaatttctactaaaatgtccaagtagaatgtttccttttacaatcaaattactgtatttattaatttgctagaatccagtaaatcattttggtagctctggctgtgctatcaataaaaagatgaaagcaacaagttgattttttttaggtctactattgattgaacattctccaatgggcaaggctcattgtcaaagcagggtgaacatgatcagattttcttctgcatcatcacacaagctgcgagtgttgctgcaaagcacttctcagtactccttccctaacctcagtatgttaatagccattcatacttggcttaagcatcaccattctggccacagtctgagagattagtgatcaaagctcccttccctatcactaccaccacctactgataacaaagatttctgaatacttagtagtagtaaaatatttttcaagcacagagttacagctaatcctggatcacttgttctaaattcataagggagtatatcaagagcaaatgaagtaaatgattctttcctgcgtgtgggagtcaccatcattttattcaaagggagttcctgtgataggttcattccttaagtggtgctacagaaggaccctaggaaaatgctgatcttgtcctgagaggcaactgatttgagaaaatgattatactacagcaggaaggcagcaccagtgaacatatggtaaatggcaaaaacaagacagttttagaaactgctaattcagtagcagccttggcctttcccttaactcaagcaggctggaatctgtctttatagtcggcaactttccaagataaagcagtgataatagcagttggcaacactaaatatcaatatcatcaccctttaatgacatgttacccctttcagatctagaaaatcagggaaaaagtgatgtcccaactctactctaaaaacctgctcctactattttagtcagtgtttctttaaggaagaagaggactatgtccccaaaagctaactctgttttatagccctggtggatccctgaaaaccctatttattctatactgggctttggaatatgaaaaatggacctgtgtggccgggcgtggtggatcacacctgtaatcccagcactttgggaggtcaaggtgggcggatcacttgaggtcaggagttcgagaccagcctggccaacatggtgaaactccatctctactaaaaatacaaaaattagccaggcatggtggcgcacacctgtaatcccagctacatgggaggctgaggcaggagaattgcttgaacccgggaggcagaggttgcagtgagctgagattgcaccactgcactgcagcctgggcaacagagcaagtctctgtcttgcagcagggggaaggacctgtggtactcctacaaacttaacaactttagcttttcggggaacagtggtggtctccacagatagctagaatcttctaagatgaaaataaactgtttcatccagctgctttctgcctgttaacctttgccacttccattccttcaagtgtgtaatccccagggttgtcttgtattacacacatccttgttaagtaaatataccactgttgatttcttcttccagtgcaacatttggattaaataaaaatctttagtttccaga

SEQ ID NO: 104963 - DNA, 2320 bp, Homo sapiens
  Payload ID: 601
  Gene Symbol: AP3M1
  Gene Name: adaptor-related protein complex 3, mu 1 subunit
  Uniprot ID: Q9Y2T2
  ENST ID: ENST00000372745
  CDS Start-End: 218-1474
agctgcgggtcctcgcggccttctcggcttctccagcttcggtaggagaggatccggcgccgaatcactgactggcacaggtgttgggatagtgtctcacttggtcacccaggctggagtgcagtggcgcaatcttagctctctacagcgtcgatcttcctcctgggctcaagcaattctcctgcttcatcctcctgagtacctaggactacagaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgagttcctacatcgagttgctgacacttttcaggactactttggtgagtgttcagaggctgcaattaaggataatgtggtcatagtatatgaactcttagaagaaatgttagacaatggatttccactggctaccgaatctaacattttgaaagaattgattaaaccaccaacaattctacgctctgttgtcaactctattacaggcagtagtaatgttggggacacactccccaccgggcagctgtccaacataccatggcgtcgggcaggggtaaagtacacaaacaatgaagcctattttgatgttgttgaagaaatagacgcaattatagataaatcaggatctacagtctttgcagaaattcagggggtcattgatgcttgcattaaactatctggaatgcctgatctctccctttctttcatgaaccctaggcttctggatgatgtcagctttcacccctgcatccggttcaagcgttgggaatctgaaagagttttgtcatttattcctccagatggaaatttccgactcatatcataccgtgtcagctcacaaaatctagtggcaataccagtgtatgtgaaacatagtatcagctttaaggagaacagttcttgcggcagatttgatataacaattggaccaaagcagaatatggggaaaactattgaaggaattacagtgacagttcacatgccaaaagttgtgctgaacatgaacctgacacccacacaaggcagctatacatttgatccagtcaccaaggtactaacatgggatgtgggaaaaattactccacaaaagctcccaagtcttaaaggactggtaaatttacagtctggagcccccaaaccagaagagaatccgagcctcaacatacagtttaagatccagcagcttgctatttcaggcttaaaagtaaaccgtttggacatgtatggggagaaatataagccatttaaaggagtcaaatacgtcacgaaagctggaaagttccaagtgaggacatgagaagaggccaaaattcctcaggaccagtttgttttccaagtgtcattacgatgtatcactattaggtaccaagtgagtgggaatacatattctagttaaagcatttgtgtctagctacacaccgctaacaaagttacttagttatcaatgtaggattcttaaggagctttaagctaaggaaaccttttagtgacttagcttattttgtatcttttcacttaggaagattttggaggtgatttttttccataggaggataccatctggcggctgcacattgtaacagtaaaggcagaaagctgtagtgataacctctctcctaaaagagttaactggtctcatccagcagaagctatcttaaatctgtgatgtgtcaggtgcagccaaatatcacaccttctgatcttagccatcccaaaccagtatctgtcccgagaggaaattccccccacccccagaagtttacagaaaactgcctcttcaagtgtttgccttattcagcttttcacttgtgccattaagcaagcactgtagcaaaagccacttccacatggccctggcagggagcactgctgctccatgctccattctcactgtacttggtattgtattttttataaataagatttttatgtaaagcttagaatttgatttacagggaccttgctgcagtaaataccatctcaattttgtgccactggttcagctgttagcacagtaaaaaaatcatttgtatcaaaggggcaaatgctttattaaggtagtaaaagggaacattacttctgcttttaggaagttactgcaagcacaagcatttgtgcttttaagcaaattaaagtagtaaaa

SEQ ID NO: 104964 - DNA, 3661 bp, Homo sapiens
  Payload ID: 602
  Gene Symbol: AP3M2
  Gene Name: adaptor-related protein complex 3, mu 2 subunit
  Uniprot ID: P53677
  ENST ID: ENST00000174653
  CDS Start-End: 283-1539
atacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccagggagggccttttggttgaatggaactgaatatcgctgcttttgtttttagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtc

SEQ ID NO: 104965 - DNA, 3545 bp, Homo sapiens
  Payload ID: 602
  Gene Symbol: AP3M2
  Gene Name: adaptor-related protein complex 3, mu 2 subunit
  Uniprot ID: P53677
  ENST ID: ENST00000396926
  CDS Start-End: 168-1424
aatcagcgggcgagcggctgcctcagcgcgcgcggcgggcggggcggggcctgtccgcgcctaggagcagtgggcgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagt

SEQ ID NO: 104966 - DNA, 462 bp, Homo sapiens
  Payload ID: 602
  Gene Symbol: AP3M2
  Gene Name: adaptor-related protein complex 3, mu 2 subunit
  ENST ID: ENST00000522606
  CDS Start-End: 1-293
tcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctgaagactttcatgtttgctcttatttctattttggaaccactgggcctttccaggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctg

SEQ ID NO: 104967 - DNA, 3669 bp, Homo sapiens
  Payload ID: 602
  Gene Symbol: AP3M2
  Gene Name: adaptor-related protein complex 3, mu 2 subunit
  Uniprot ID: P53677
  ENST ID: ENST00000518421
  CDS Start-End: 292-1548
atacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccagggagggctatcttcaggctcatgcaggaggggaagattgggcctggtcttgaaagatggagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtcagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgagttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcgccctagaaaaagagaaagcttaccatcgagggtgtggttgatccttgaagctgcttggtaaagttatcatttcctcagtcttttcttttgtactcctatcatgtattcattaatatctaccagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccgtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttatttcctctagaactcatcctgtttcaagggaagtacctaagaagatatagagtgtttctagggtaagggacctgcaggtgtaagcatagatgaaataactgtcctgtcacatgtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagt

SEQ ID NO: 104968 - DNA, 602 bp, Homo sapiens
  Payload ID: 602
  Gene Symbol: AP3M2
  Gene Name: adaptor-related protein complex 3, mu 2 subunit
  ENST ID: ENST00000517499
  CDS Start-End: 1-396
gattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgtt

SEQ ID NO: 104969 - DNA, 1094 bp, Homo sapiens
  Payload ID: 602
  Gene Symbol: AP3M2
  Gene Name: adaptor-related protein complex 3, mu 2 subunit
  ENST ID: ENST00000517922
  CDS Start-End: 73-879
agttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagatt

SEQ ID NO: 104970 - DNA, 574 bp, Homo sapiens
  Payload ID: 602
  Gene Symbol: AP3M2
  Gene Name: adaptor-related protein complex 3, mu 2 subunit
  ENST ID: ENST00000522288
  CDS Start-End: 157-574
aggagtgggggcgcgcgagggtcggggcggggtctcaggatgcagccgggcggcctctcagggctgcggacgcggcggggagagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatcc

SEQ ID NO: 104971 - DNA, 687 bp, Homo sapiens
  Payload ID: 602
  Gene Symbol: AP3M2
  Gene Name: adaptor-related protein complex 3, mu 2 subunit
  ENST ID: ENST00000520689
  CDS Start-End: 1-147
cccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccacccgctcccttttttccttagccttcagtgccatggaactaatcaagggaggaaaaggtcaccagggagaactggacagaactgaaacacagcaacaccagttctcaaggacaagttctactcacttccttttacagaattcaccggccattttcctgttacctgatccttctacaggatttttaaaaagtaagagagtttcagagaagccgatcccataatccccagtgcagccagggtttgtgtgtcatcgtactggagtagagggccgactcttcccatgaaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaa

SEQ ID NO: 104972 - DNA, 2778 bp, Homo sapiens
  Payload ID: 602
  Gene Symbol: AP3M2
  Gene Name: adaptor-related protein complex 3, mu 2 subunit
  ENST ID: ENST00000517865
  CDS Start-End: 1696-2025
ccaggccgcgggccggccaatcagcgggcgagcggctgcctcagcgcgcgcggcgggcggggcggggcctgtccgcgcctaggagcagtgggcgctgagagcagcaaggccaggtgaggagtagggacgaccccgagcctggagagggggcaggagtgggggcgcgcgagggtcggggcggggtctcaggatgcagccgggcggcctctcagggctgcggacgcggcggggagaggtgaggggccgggttcagagttcggggagggcgtccttcccggcgccgcggctgcgggcggaggggacactgttgccatggcagcgcacgtgcgctcgctggcgcggcccggcacccctgcgctcttcaccccggaacgcgcgtgccccttcagccaggcccctgcccgcctgcgccccgcggcctccgtcgccgccggctctgggccggggcctgcgcagggaccgcctgcctaggccgctgcctctccctcgcaccccgggctgcctggctgtctctccctcctgctgtctcctccaggcggcgctgggcaccgcaggcctctgcgttttgaccacccgcgccggttcgcggaatggccacatcctggcgactggcaccagagagatgcaaccgtctgagggccttggggtgtctgtcccccagggaaatttttttttttttttggaggtggagggggcggggttctccctctgttgcccgggctgatctcgaactcgtgagctccagcggtctgcccgcggaggcctccctaagtactgggatcacaggcgggagccccaagggatctttttaaatgtcttactgcattaacaagtgcctaaggagtgctcagagaatagctctgattggatgaataaagacccccaagggcagctttccattcctcccaccaattctggtgggcagaaatagaaagcaaaccacatatgtaattgtacatgttctggtaaccactttaaaataataaaacaggttaaattaattttaatatatttgatttaacccaggatatccaaaatgttattacaacatataatcaatattaaattattggtaagatatttgaaattttttttttcatgcaaagcctttcagatttgtcgtgtgtcttacacttaacagcacacctcagtccgcaccagccacctttcaagtgctcgctggtcccatagtggctatcgtattaagctgcgcatttcttgtgtatgtgtgagctgttgccaaaacatgacatcaaattcagtgttcttggaagccctcttcaaagaacactgattgtgttgcagtcaggcaacgcaaaacatgaggcacggcccttttcttcaaggagtttgcggttcggttgagaaaatagacacccacagataagtagtattttaaatggatgcaatttgggcgatagtaaagataactgggagtatatgattgacagtcagatgactgatcattatcgtttcgaattcaagggagggctatcttcaggctcatgcaggaggggaagattgggcctggtcttgaaagatgggtaagtcttggactgttgggaaaagatggggagggccttttggttgaatggaactgaatatcgctgcttttgtttttagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcagtactactgttctggaatttcagttctcatgcaacataccggcccctttgcacagtgaaaacgattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagatt

SEQ ID NO: 104973 - DNA, 509 bp, Homo sapiens
  Payload ID: 602
  Gene Symbol: AP3M2
  Gene Name: adaptor-related protein complex 3, mu 2 subunit
  ENST ID: ENST00000517969
  CDS Start-End: 479-509
cagcacacctcagtccgcaccagccacctttcaagtgctcgctggtcccatagtggctatcgtattaagctgcgcatttcttgtgtatgtgtgagctgttgccaaaacatgacatcaaattcagtgttcttggaagccctcttcaaagaacactgattgtgttgcagtcaggcaacgcaaaacatgaggcacggcccttttcttcaaggagtttgcggttcggttgagaaaatagacacccacagataagtagtattttaaatggatgcaatttgggcgatagtaaagataactgggagtatatgattgacagtcagatgactgatcattatcgtttcgaattcaagggagggctatcttcaggctcatgcaggaggggaagattgggcctggtcttgaaagatggagttgaaaacttacagagtcctgaggctttcagactgaaaaaggctttcttctgtcactgacaatcgccaccatgatccatagtcttttcttgatcaactcct

SEQ ID NO: 104974 - DNA, 966 bp, Homo sapiens
  Payload ID: 602
  Gene Symbol: AP3M2
  Gene Name: adaptor-related protein complex 3, mu 2 subunit
  ENST ID: ENST00000521280
  CDS Start-End: 105-966
ggagcagtgggcgctgagagcagcaaggccaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaatctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaacccttta

SEQ ID NO: 104975 - DNA, 1212 bp, Homo sapiens
  Payload ID: 602
  Gene Symbol: AP3M2
  Gene Name: adaptor-related protein complex 3, mu 2 subunit
  Uniprot ID: P53677
  ENST ID: ENST00000530375
  CDS Start-End: 94-915
cgctgagagcagcaaggccagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggaagcacgaatgtgggtgaccagcttcccactgggcagctgtcagtggtgccttggcgacggactggggtgaaatataccaacaatgaggcctattttgatgtgattgaagagattgatgcaattattgataaatcaggctccacaattactgctgagatccagggggtgattgatgcctgtgtcaagctgactggcatgccagaccttacactttccttcatgaaccctaggttgttggatgatgtcagcttccatccttgtgttcgtttcaaacgctgggaatctgagcgcatcctctccttcatccctcctgatggaaacttccgcctgctgtcttaccatgtcagtgcacagaaatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaa

SEQ ID NO: 104976 - DNA, 1730 bp, Homo sapiens
  Payload ID: 603
  Gene Symbol: AP3S1
  Gene Name: adaptor-related protein complex 3, sigma 1 subunit
  Uniprot ID: Q92572
  ENST ID: ENST00000316788
  CDS Start-End: 558-1139
atccgtaagtccttcccctccagcagcaattgaagtaggaagctgcaacacagactgcggctcctccgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttccgctttccttagtgcctgccccgcccaggccccgccccttgggccccgcccgacggctcgggagcgcgcgcggtcgcgtgcgggagggggcgggtggggaaggatcgcaggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgaggctggcttagcaggagctccagcccgtgctgtatcagctgtaaagaatatgaatcttcctgagatcccaagaaatattaacattggtgacatcagtataaaagtgccaaacctgccctcttttaaataaaaatgtaaaaaggccactcccaggtaaaatccagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgcattcctgtgcccacctacggcatgcctctatgtattggctactacagtgttttaaaaagtgtttcagatatttctctaattatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactattaa

SEQ ID NO: 104977 - DNA, 718 bp, Homo sapiens
  Payload ID: 603
  Gene Symbol: AP3S1
  Gene Name: adaptor-related protein complex 3, sigma 1 subunit
  ENST ID: ENST00000506430
  CDS Start-End: 81-569
caggcgagattacgaggcgaggctcgcgcgcccgcccccgccctggcccccagtgcccacccggtcggcccggcacagccatgatcaaggcgatcctaatcttcaacaaccacgggaagccgcggctctccaagttctaccagccctacagtgaagatacacaacagcaaatcatcagggagactttccatttggtatctaagagagatgaaaatgtttgtaatttcctagaaggaggattattaattggaggatctgacaacaaactgatttatagacattatgcaacgttatattttgtcttctgtgtggattcttcagaaagtgaacttggcattttagatctaattcaagtatttgtggaaacattagacaaatgttttgaaaatgtctgtgagctggatttgattttccatgtagacaaggttcacaatattcttgcagaaatggtgatggggggaatggtattggagacaaatatgaatgagattgttacacaaattgatgcacaaaataagctggaaaaatctgagacctttatctttcagtctcccagacaggacaggtagacaagcaaatagtttacactggcctattttgtatcagtcaagatttttctcaggctggcttagcaggagctccagcccgtgctgtatcagctgtaaagaatatgaatcttcctgagatcccaagaaatattaacattggtgacatcagt

SEQ ID NO: 104978 - DNA, 5891 bp, Homo sapiens
  Payload ID: 604
  Gene Symbol: AP3S2
  Gene Name: adaptor-related protein complex 3, sigma 2 subunit
  Uniprot ID: P59780
  ENST ID: ENST00000336418
  CDS Start-End: 394-975
acgttctgcgagcgctaaggggatggcgggagtgcatgatttggagcgggcggtgagaaaagcaagctcccgccgcctctccgttttggcaacccggctgacggtcgtttcggcttctggggccagccgtcggtctgggcgagggacatagatccggattcgcatcctgactggccaaccaacgctggccgaggtgaccactctcctcggcatccgcacctgccctccaaggcgtcagagaggccggacccttgggtgctagggctcgtgagcgccggggccaagtttccgagtgccgctctcagcagcgcaccaaccggaagtgatcgtgttgtggcggaaggaggagctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaattttaggagaaccagagtcacccgctggctctactgagattgttacacccagaatccttttgtgtttttttgtggttttttttttttgaggtggagtcttgctctgtcacccaggctggagtgctgtggtgcaatctcggctcactgcaacctctgcttcccgggttcaagcatttctcctgtctcagcctccccagtagctgggattacaggcacccaccaccatgcccagctaattgttgtatgtttagtagagacagggtttcaccatgttggccaggctgggctcgaactcctggacctcaagtgatctacccgccttggcctcccaaagtgctggcattacaggtgtgagccaccgtgcccggccaccagaatcctttggtatagccaagccttttggttaccgcctcatgaagaatatgcttcccgcattgtcctagtcccagttgtattctcacaggtgttatgtgcaggacacaatccaaatcataaacctggctcatgcccaacacatttctgctaatagggagagggacccaccacacacccacacatgccagaggtccctcctcacagaggagagggcctgtgtctgtagaaggttaaagctgacaacatgtgaaacatcccagaattatgactcttcccaagtttaaaatacattctcctcatgagagcagaaggtttgttgctgtgttgtgaatgatgagctgcctccatagggaacccactgccacctgggccagcttctggagcatgagaacctgagccagggtcacccttgtggggcctggacatgacgcacgctggctgcgactaggagcagggctgcctcttctccctccccaaggtctgcttgtgggcacgctctgttccctcaggtgccattctcccagggcttaggcgcccataaatgttctttctgtggtggagtagggcctcctgcttccatactgtcgcatgggctagatctcaggtgtggtgttgagccaccttaagatgagggctgcttcgcagtaaagtttccagcctgggcccctcttgggccttctggctggggaccctcagcctcctgatgctgttgcagggcaggtctgagagggtgcccagcagcacccggtgtcagggccaccttgttttccatttttgaacagcgctccctgtggtttgtgcccactgctcaatacagcctccgatcctcactcttgaaagctccatgataagcacagagatgggcagtgtgggtcagaaggtgggccgcttcctgtggaagagggaagtgtaggtgaatagatatcaaaacccctgatgtcattcttttgaggggttggattttcttttttctggcagacatttcagtacattcacatttctctcacatttgctgaatgtgagatcagaataaaggagatcggcgtttatttcgtaccttctgtaagttggcatgagcaagatcattcaactgtccttacaacaggcattcttatccccattttgcagatgacgaaagtagacccagctccagtaaccttcccttagattacacggggctgagatctgagactgttcacttgactccactgtccttttctttcctcgctgcttaagatggcttctcccaatgttatcatcttcttttttatagataaggaaactgagcctcagagagtctgacttctcacaaaccgtggtctaaataggcttgattttctaaggtggccagtgatcatgtcatagagtataagagccaaagagtcgtctgtgtccctccatttaactgatgttgaagccgaagcccaaggtggtaaatgttatgttgagggtcacaaatccagagccacatccctcttcttgagttcgtttgttacgtggtttaatgcattactgcaggacagcccttatgctagatttcctgggatagcctagattttgaatgttttgcctgccagaaaccaatggttttaaaaaatcattgagtggtcctacagattcaaagcgagcatccaaacatccctcacatggcctcttacaatgacataaaactgaagcccacttttttatttggaaaactcaatccctttggacaagccacaataatttttcattaactacttgaggttgcctgcaaattcagctagctttccagcctgctatcagcaaagccataaacatcttttttaaaaataggttaaggttggccaggtgcggtggctcacgcctgtaatcccagcactttgggaggccgaggcgggcagatcacgaggtcaggagatcgagaccatcctagctaacacagtgaaaacccatctctactaaaaatacaaaaaattggccagccgtggtagtggacacctgtagtcccagctactcaggaggctgcggcaggagaatggcatgaacccgggaggcagagcttgcagtgagccaagatcgcaccactacactccagcctgggcaacacagcaagactccgtctcaaaaaaaaaaaaaaaaaaaataggttaaggttgtatagaatactaggctttcctttttttgtgagatgggggtctcacactgtggctcaggctggagtgcagtggtgtgatcatggctcactgcagcctcgaagccccggggtcaagtgatcctctcacctcagcctcctaggtagctggaaccacaggcacgcaaccaccactcctggctagttttatttttttagtagaataaggtctcactatgttgcacaggctggtctctaactccttacctcaagccatcctcccgccttggcctcccaaacatgttgggattacaggtgtgagccactggacctggccaaatactgggttttcagtgctcactgccactaataaaaatctgaaattctttcattatgcaatttctaagtgcctggtgagggccaagctcagttctaggctctgaagattaagagagaaacaaggctctgtctgctcctgttgtctctgtgagcatctttgacagagtgctcagattgttgggatatagtgcatcggactggcagcctgaatttgtggagaccgcagtcagtaactttgtgatatatggaatatttagaggacagtaacccatttccctacgccctacctgatcacatcgtgccctgctgggccataccccaaacagcccaccttcctctaggcctggccatggccctgtgcctgccacattgaggattaagtcaggatatcttgagccctctcaaatccctgtttattcaggcctctgccacatatagagccagccttctgtccccaccacttccactaccatggagcccacttagtaaaacgctctctgggcccagcttcgccagaaaagacaccaggggagcaaggctcaaaccaggggcagctaaatctgatcttgtggaccagtctctagtaagggctttcagcgtggctgtctgtccattgctttccaaataggatgcagcaatgattggtacatgggtattaagatcggtagtaggggctagtccaagtttagcaatagccaaactggagagcctctgaagtatgagagtcccagagggatttgtcagctcctggcagacatcctgattttcaccttcctgagtctaccctaccccagagggtgccagtctcactgtggtgatggttagcccagtgtgtgctgcactcacacaccagcacggggtccgtgcttgcaggctggtggatgctgtcctctgggttaagactgtctcccttctcgggagcactggagggttctccatctgcgtgtttcagtggaagttggcagatacgaaaacaggcccctatagggaagcagttccatgaaaatgattaattctttccaaaagacttaaaattttttcctatttcaattttcctttcaaaaaaggaaatacattcatgtagttcaaaacttaagaaaacaaaagtctgttcagcaaaagactcccactccggttccccaaacgctgagccccaccccccatccctggtagcaagaagtgtttccaattttaaggttaagaaacaaagtccctggatttgtgttagggatgtcttcctgagagtgggttgtgttccgtttgaccctggcggttgacctcggcccactaggatcatgccgccctctccagggaggagggcctccccatcaccctgtacagtggcaccccagccctggcactgcccgcccttgctcagcgtacctttcccatggcactctgacgtactggatgtttggtttctgaagttactggctgtttaccctgccgggatgtaagcccctccagggcaggggcttgtctcgtgttcagtgctgcatcccagctgctgggcacggtacctggtccatggcgttcaataaataactgttggatgagtgaa

SEQ ID NO: 104979 - DNA, 1262 bp, Homo sapiens
  Payload ID: 604
  Gene Symbol: AP3S2
  Gene Name: adaptor-related protein complex 3, sigma 2 subunit
  Uniprot ID: P59780
  ENST ID: ENST00000423566
  CDS Start-End: 29-403
ggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccagcttaaaaaaagagagaggaagaaaagccagtgcaacaccctacaaactggaacactagctctttgggaacaaggacctgacatcagaacaagaaggctataagttcccaaaccttaaaagtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaacccattttgagccttagaagagtcaagcctcaggacctggaaactttgtgtctggggaagactgtttggcatggaatagggaagggattcctattgacactgctcgggtgcacccagttctcacatgtgcagtcatgccgttctctgatgcatacggccactgcagatgtgaggggccctgccttcctcagtagggagtcaacatgcccaagtcatttgcacctttacctctcacatggatgctcccaagggttagggactgcattgagcaggcccacctgcttcccagaacctcctcactagggctgagcaccttctctgagtagagtcttcatccttagcaccacagacttctgaggtcctgtgccctttacttgctggtgaggtgtcataggtagaaaagggctggcccttcagatctgggggtgtggtgagtggcaagtaagggcagaatttta

SEQ ID NO: 104980 - DNA, 578 bp, Homo sapiens
  Payload ID: 604
  Gene Symbol: AP3S2
  Gene Name: adaptor-related protein complex 3, sigma 2 subunit
  ENST ID: ENST00000557999
  CDS Start-End: 46-180
gctttctgggagtagccggtgctgagagaaccgtggctggcaaagatgattcaggcgattctggttttcaacaaccatgggaagccacggctagtccgcttctaccagcgtttcgtgaccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaaca

SEQ ID NO: 104981 - DNA, 738 bp, Homo sapiens
  Payload ID: 604
  Gene Symbol: AP3S2
  Gene Name: adaptor-related protein complex 3, sigma 2 subunit
  ENST ID: ENST00000558011
  CDS Start-End: 46-663
gctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtacatctggaagttgttttcttcatagctcccaaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacatcaacctgccagagattcctcggaacatcaacattggcgatctcaacatcaaagttcccaacctgtcccagtttgtctgaggatcaagtattggcctgaaatagagtccttaagacaagcaaagacaagcaaggcaagcacgtctggaaacagaa

SEQ ID NO: 104982 - DNA, 573 bp, Homo sapiens
  Payload ID: 604
  Gene Symbol: AP3S2
  Gene Name: adaptor-related protein complex 3, sigma 2 subunit
  Uniprot ID: P59780
  ENST ID: ENST00000560251
  CDS Start-End: 29-403
ggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccagcttaaaaaaagagagaggaagaaaagccagtgcaacaccctacaaactggaacactagctctttgggaacaaggacctgacatcagaacaagaaggctataagttcccaaaccttaaaagtttttgtggaaactctggataagtgtttcgaaaatgtgtgtgaattggatttgatcttccatatggataagtgcaattcctgggtcataggtgaggcctctagaaggaagaaacaggcctctagaaggaagcacaaaagcaccagcagggct

SEQ ID NO: 104983 - DNA, 653 bp, Homo sapiens
  Payload ID: 604
  Gene Symbol: AP3S2
  Gene Name: adaptor-related protein complex 3, sigma 2 subunit
  ENST ID: ENST00000558999
  CDS Start-End: 46-456
gctttctgggagtagccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtacatctggaagttgttttcttcatagctcccaagcttaaaaaaagagagaggaagaaaagccagtgcaacaccctacaaactggaacactagctctttgggaacaaggacctgacatcagaacaagaaggctataagttcccaaaccttaaaagtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgag

SEQ ID NO: 104984 - DNA, 519 bp, Homo sapiens
  Payload ID: 604
  Gene Symbol: AP3S2
  Gene Name: adaptor-related protein complex 3, sigma 2 subunit
  ENST ID: ENST00000560940
  CDS Start-End: 33-503
agccggtgctgagagaaccgtggctggcaaagatgattcaggcgattctggttttcaacaaccatgggaagccacggctagtccgcttctaccagcgtttcccagaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgaggatcaagtattggcctgaaatagagtccttaaga

SEQ ID NO: 104985 - DNA, 578 bp, Homo sapiens
  Payload ID: 604
  Gene Symbol: AP3S2
  Gene Name: adaptor-related protein complex 3, sigma 2 subunit
  ENST ID: ENST00000558806
  CDS Start-End: 80-190
aaccggaagtgatcgtgttgtggcggaaggaggagctttctgggagtagccggtgctgagagaaccgtggctggcaaagatgattcaggcgattctggttttcaacaaccatgggaagccacggctagtccgcttctaccagcgtttcaagaaattcaacagcagattgttcgagagactttccatctagtcctcaagcgggatgacaacatctgtaacttcttggagggtggaagtttgattggtggctctgactacaaactgatctaccggcactatgctaccctctactttgtattttgtgtggattcctcagagagtgaacttggaatcttggacctcatccaggtttttgtggaaactctggataagtgtttcgaaaatgtgtgtgaattggatttgatcttccatatggataaggtgcactacatcctccaggaggtggtgatgggtgggatggtgttggaaacaaacatgaatgaaatcgtggctcagattgaggctcaaaacaggctggagaaatccgagggtggcctttcagcagcccctgcgcgggctgtgtctgctgtgaaaaacat

SEQ ID NO: 104986 - DNA, 1561 bp, Homo sapiens
  Payload ID: 604
  Gene Symbol: AP3S2
  Gene Name: adaptor-related protein complex 3, sigma 2 subunit
  ENST ID: ENST00000617003
  CDS Start-End: 690-881
atttgcatctgtatccgctgctccatctgcagtatacggacatgctccacttcacccacactgggtcattaaaagaacaaacaaaaataagaacttgatcgatttgggattttaaatggaaatgcactaaaaattccttaattccaccattcaccgtctaccatagaggaacagcccatctgcacggagagacagctacgtaattcactgcagcattataatactgaaaaattaaaatgaacgaaatgttccataaccgacgaacggccgaatgaccggcgtctccactccgcggaacgttctgcgagcgctaaggggatggcgggagtgcatgatttggagcgggcggtgagaaaagcaagctcccgccgcctctccgttttggcaacccggctgacggtcgtttcggcttctggggccagccgtcggtctgggcgagggacatagatccggattcgcatcctgactggccaaccaacgctggccgaggtgaccactctcctcggcatccgcacctgccctccaaggcgtcagagaggccggacccttgggtgctagggctcgtgagcgccggggccaagtttccgagtgccgctctcagcagcgcaccaaccggaagtgatcgtgttgtggcggaaggaggagctttctgggagtagccggtgctgagagaaccgtggctggcaaagatgattcaggcgattctggttttcaacaaccatgggaagccacggctagtccgcttctaccagcgtttcgtgagtgcggcccggcttcaccacgccccttcagggcgcccactatgtcttccctcctctttggcctctcggcgcccgggggcaccgctctttggtcacctggggctcctgcaccgagcatgaccctcgccctacttaagcatttaatctaggcgcaggctggtgccaggccttctgtctcccgccctactgccccgctctcgctgacccttttcttgatcctggcatttctgtgccattttgtgacattttcccgtgggtctctgggaacgagatagaagcgacagtggggagtgtgcctcgatgagaacttgagtgattgaagtcacattctgtcatctttttggttgttgaccacagtttcatgaggaagaaatattaagtttctgaaagtttttgttatagccagaactggaaaagttcttttttttttggaattattttgcttcagtgttggctgggactttccagagactagatacccttcactcttagggttgaagaaaatcagtttaaaagtggaaaaatgatgagaaattataaatgctgccgcataagggctcaataagtgattacgtaaatttgaattttcccaacacgttcctttgcaaacacataaacatcagtatttgcttcctgtcttcgaagattatatttcttcatggcagggtttcaaaatgttacataattgggggactggtggaactgaagaggggaaagagccagaaaacgtgttcaggcttcagctccaccttttctactcttgcgtctgttgacaagttaataaacccttttcagacttt

SEQ ID NO: 104987 - DNA, 2742 bp, Homo sapiens
  Payload ID: 605
  Gene Symbol: AP4B1
  Gene Name: adaptor-related protein complex 4, beta 1 subunit
  Uniprot ID: Q9Y6B7
  ENST ID: ENST00000256658
  CDS Start-End: 206-2425
ggggaattaaggctggaactggagagggaggggtctgcggtcagtcggacgcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 104988 - DNA, 1225 bp, Homo sapiens
  Payload ID: 605
  Gene Symbol: AP4B1
  Gene Name: adaptor-related protein complex 4, beta 1 subunit
  ENST ID: ENST00000369564
  CDS Start-End: 337-1225
ggagtcgggactacgcttagcgctcgctcgcggggagaccggcagcggtcttctgtttggtctcttgacaagggggcgggacttccgcagaaagcaagattgggcctatccgcgatgagaacggcgtggagggggaattaaggctggaactggagagggaggggtctgcggtcagtcggacgcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccatag

SEQ ID NO: 104989 - DNA, 2144 bp, Homo sapiens
  Payload ID: 605
  Gene Symbol: AP4B1
  Gene Name: adaptor-related protein complex 4, beta 1 subunit
  ENST ID: ENST00000369567
  CDS Start-End: 112-1827
ttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 104990 - DNA, 2818 bp, Homo sapiens
  Payload ID: 605
  Gene Symbol: AP4B1
  Gene Name: adaptor-related protein complex 4, beta 1 subunit
  Uniprot ID: Q9Y6B7
  ENST ID: ENST00000369569
  CDS Start-End: 282-2501
ggacctagaagtagcgggagcgatctgtgggcggggcgaacggcctgccggccgacggtagggcctgaagagcctagggtggggctcgcggtgtcgcggagggcgtggaagtgtgtcagggccagcgtgccggccctacggaagccgagcctgaggcgagatctcgccttttgtattttcactgactcatatttcctttactcaggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgagaatgtgcagcaggtgctagaggagcttcgagggtactgcacggatgtgtctgcggactttgcacaggctgccatctttgccataggtggcattgccaggacttacacagatcaatgtgttcagattttaacagagttgctgggtcttcgacaagagcacattaccacagtggtggtgcagactttccgagacctggtttggttgtgtcctcagtgtactgaagctgtatgtcaggccctgcccggctgtgaagagaacattcaagatagtgaggggaagcaagcacttatttggctacttggtgtccatggggaaagaattcctaatgctccttatgtgttagaggactttgttgagaatgtgaagtcggaaacatttccagctgttaagatggagctgctcactgctttgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaa

SEQ ID NO: 104991 - DNA, 980 bp, Homo sapiens
  Payload ID: 605
  Gene Symbol: AP4B1
  Gene Name: adaptor-related protein complex 4, beta 1 subunit
  ENST ID: ENST00000369571
  CDS Start-End: 194-980
tctgcggtcagtcggacgcggcgctggaaatccggcggaggacctagaagtagcgggagcgatctgtgggcggggcgaacggcctgccggccgacggtagggcctgaagagcctagggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattaggtacatgactcaaggcttggacatgtctggtgtttttatggaaatggtgaaggccagtgccactgtagatattgtccagaagaagttggtttatctgtacatgtgcacatatgctcccctgaaaccagatctggctctcctggccatcaatacgctgtgcaaagactgctcagaccccaatccaatggtgcgagggctggcgttacggagcatgtgtagcctcaggatgcctggtgtgcaggagtatatacaacagcctattctcaatggtctgcgggataaggcttcatatgtcaggagagtggcagtccttggatgtgccaagatgcataatcttcatggagactctgaagtagatggtgccctggtaaatgaattatacagtttgctgcgtgaccaggatccaattgtagttgtgaactgcttgaggtctctagaggaaattctgaaacaggaaggaggcgttgtcatcaataagcccattgctcaccatctcttaaatcgaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttgg

SEQ ID NO: 104992 - DNA, 681 bp, Homo sapiens
  Payload ID: 605
  Gene Symbol: AP4B1
  Gene Name: adaptor-related protein complex 4, beta 1 subunit
  ENST ID: ENST00000432415
  CDS Start-End: 156-681
gcggcgctggaaatccggcggaggacctagaagtagcgggagcgatctgtgggcggggcgaacggcctgccggccgacggctcccacatcaggacgagaaggagccctcgagttaccgtgggagctgtgggagctgccctgtgactcttaggaagatgccgtaccttggctccgaggacgtggtgaaggagctgaagaaggctctgtgcaatcctcacattcaagctgataggctgcgctaccggaatgtcatccagcgagtgattagaatgtcaaaactggaccaatggggccaggctgaagtattgaactttctgctacgctaccaaccccgcagtgaggaagaactatttgacattctcaatctgttggatagtttcctcaagagcagtagcccaggtgtggtgatgggagctaccaaactttttctgatcttggcaaaaatgtttccccacgtacaaactgatgtccttgtgcgggtcaagggacctttgctagctgcctgttcttcagagagccgtgagctctgttttgttgctctttgtcatgtacgccagatcttgcatagtttaccaggtcactttagcagccactacaaaaagtttttttgctcctactcggagccccactacatcaaactacagaaagtggaggtgctgtgtgaactggtgaacgatgaga

SEQ ID NO: 104993 - DNA, 6758 bp, Homo sapiens
  Payload ID: 606
  Gene Symbol: AP4E1
  Gene Name: adaptor-related protein complex 4, epsilon 1 subunit
  Uniprot ID: Q9UPM8
  ENST ID: ENST00000261842
  CDS Start-End: 107-3520
aaaaacaggaagtgcctacggaggccgggccggcagcggcggccgggcatgaagccgggcggctacgggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccctgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaaggacaagtgaattaatgtatgatgttcttgatgaatccttacgaagagctgagttaaatcacaatgtcacatatgctattttgtttgaatgtgtgcatacagtctattctatttatcctaaatcggaattacttgagaaggctgccaagtgcattggaaaatttgttctgtcacctaaaataaatctaaaatatttaggactgaaggctcttacctatgttatccaacaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagatttcttcaagttatgagttgggtattaggggaatattcctacctcttagataaggaaacgccagaggaagttatagctaagctctacaagttacttatgaatgactctgtgtcttcagaaacaaaagcctggttaattgctgctgtgaccaaattgacatctcaggcgcactcttctaatacagttgagagattaatccatgaatttaccatatctttggatacttgtatgagacaacatgcatttgaattaaaacatttgcatgagaatgtggaacttatgaagagcttgcttccagttgacaggagttgtgaagacttggtggtagatgcttctttatcttttctggatggttttgtggctgaaggactcagtcagggtgcagcgccttacaaacctccccatcaacgccaggaggaaaagctttctcaggaaaaagttctcaattttgaaccatatggactctccttttcttcatctggcttcactggacgacagtctcctgctggcatttctcttggttcagatgtatctgggaatagtgctgagacaggactgaaagagacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctgctgggaaaagcagatactgtctctcacaagttcagaaggaaatcaaaagtcaaagaagctaaaagtggcgaaacaaccagtactcataatatgacctgttcttcctttagttctttgtcaaatgtggcatatgaagatgattattattcgaatactttgcacgatacaggagacaaggaattaaagaaattttctctcacttcagaacttttggattctgagtcactcacagaactgcccttggttgagaaattctcatattgtagtctgtctacaccttcattgtttgctaataacaacatggaaatttttcaccctcctcaatctactgcagcctcagttgccaaggaaagctctttagcttcatcttttttggaagaaactactgaatacatacactcaaatgctatggaagtctgtaataatgaaactatatcagtgtcttcttataaaatttggaaagatgattgtttattgatggtctggtcagtcactaataagagtggtttggaattgaaaagtgctgacttagaaatttttcctgcagaaaatttcaaggtgactgagcaacctggatgctgtttgcctgtaatggaagcagaaagcaccaaaagctttcaatatagtgtgcagatagaaaaaccttttacagaaggaaatcttactggttttattagttatcatatgatggatactcattctgctcagctggaattttctgtaaacttatcactattagatttcattagaccattaaaaatctcaagtgacgactttgggaaactctggttatccttcgcaaatgatgtgaaacaaaatgtaaaaatgtcagaatctcaagctgcacttccttctgcactaaagactctgcaacagaaactaagactccatattattgagattataggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttgtgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaagggagacatgaaattgataatctcaaacttaattcatatttggctttggaatgtagtgtatggtttttggtagggaagtcaatattttcgattatgttttgcttagatcagtgttgaactaagttggcatagcacacactaacagttgtaggagatccatgagcatgctggatattgaggggatccaatctgtgatctattttttattatagataactgttacacataatttcagatcgtttggctgtaaaatttgtctgttttccacttggagttattttaaaattcaaagtaaatcactctattcttattttgaaaactcagagccattttatatagaaacaaaacccataagagcacacagtaacaaagcaaacagatacaaaaatgactttttagttatgacaaatattttagttggttactacttaggtccttttggcaaatgaaaatttgtgattagagtataaatggcaaaactatcttttcctggcctttgaatccactagtacttaatggatatagctgaagcagagactaagtataacatacaggttcttcagtaaaatatatcattttcatgttatagttatgcctgtgtggcctctgtcagaactattatcagtaaaagaggttaagcctatatatgaatgatggaccaaaaccttgaggttgtacattaactgaaatagtattttataaaatcttatggtgctgtggaaaatatttattatttcaccttttctgacacttcaccatggagactattcaggtaatacaattttaagtcattgcagttaatactctggttaattggtactgttaatcacccaggtcaggaattctgattttaggttatctcattaatcatggctgataaagaagctaaggggattctccagatctaatagatttcattagtcatttgtgtcgagtattcctccctaaaaacaaaagcagtattttctttctcaattaatttttaagttattcattaaaaaatatataacatcttaattttattcttttaaaaacatacagtgaagccttgctacaagagtcataagtgactggaatttcttgcataataggttcctccttttgaatagatcagattcatccccaggctctcagcagtgtcatgatgaaatgagtgtgctgacttcaggggtgtggtggacactggtagctagccttatcagctccctccttattcctacctctgtcagcagcatgcctcgccccttacctaattctgctgtgactctgacagagaggaagtgccttctcactttgcaaaggaatgcagcatgtcacaaaggaggtgctccaattttttgtgtccttacttccctatgtttgcctagttactgaggctaggtcgagtgtgaagcaataggtgtaagatgctgagagcacatggacagctaccagggagatctgttgcttggttacagggtgtattcatgagtggtagctgcagttgtcgtgagagacatgcttggcatacagagctgtctaatgggtgggagacatgtaatggtagatttagggctgggagcatgattttgggtctgcccaaaggaacatggtgtcacttttgttctttctgacccactaaataaaaagtagtgtaacagggtttcactggaatgtttattagaaagtttacactttttatatttttatgattttaaaaacaaacaataatagaaaaacagattttaaggaacttcagagcagtatatattctgtctaaactcactgaatattttaagttgtaaatcaggtgtccaccaacctttatttttgcattgcaggagatgtgactgtaaagtagggagtttttttttttgagacagagtttcacccttgttgcccaggctagagtgtaatggtgcaatctccgctcactgcaacctctgcctcccaggttcaagcgattctcctgcctcagcctccctagtagctgggattacaggcatgcaccaccacacccggctaatttttttatatttttagtagagacaaggtttctccatgttggtcaggctggtctcgaactcccgacctcaggtgatctgcccgcctcagcctcccaaagtgctgggattacaggcgtgagccactgcgcccggccaaattatttttgtgggtagattcattctctttacctaatagtcataatttagtcagtgaagggacaacatctggggtaagagctatggaggaggtgctcagctttgtgagttttgtgccaggcatctttgctgaaaatggagatggcagcaagtgtgaatctgggggaatataagggaagacagaaaagccttaagagtagacggaggaagaagggtaccagaatagtccctgtggaggcaggcagatcagagctcagggtttgaaagtgggcctgagtaagggtcctgctagagaaactgcagatggaagctgagcagttaccaactgctaatgtgccaagtataccaagcacagcatgtgtcctgtagaggagcattattttaaacaatgttctactatcatctaccaaaataattgtggtaaaagtgtagtattttattttttccttttatgtcagcaatattttaaaatattgatctgtttatcttatatttttatggataaatgtagtatttgcctcatgattgtgagccactgagagtgcactgaacctattcacatgtctttaagatgttttgctgtgttaaaattttaggagagaaaaatacaagtgaataattatttaataggcatttattactttattttggagttgaattctgtcatttgaaaaagttcagtaatgtaataaatacaaagtgatctgcactgtt

SEQ ID NO: 104994 - DNA, 4024 bp, Homo sapiens
  Payload ID: 606
  Gene Symbol: AP4E1
  Gene Name: adaptor-related protein complex 4, epsilon 1 subunit
  ENST ID: ENST00000561393
  CDS Start-End: 355-1011
aaaaacaggaagtgcctacggaggccgggccggcagcggcggccgggcatgaagccgggcggctacgggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgctactggatattttgcttttcagaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccctgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaagctattttgtttgaatgtgtgcatacagtctattctatttatcctaaatcggaattacttgagaaggctgccaagtgcattggaaaatttgttctgtcacctaaaataaatctaaaatatttaggactgaaggctcttacctatgttatccaacaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagatttcttcaagttatgagttgggtattaggggaatattcctacctcttagataaggaaacgccagaggaagttatagctaagctctacaagttacttatgaatgactctgtgtcttcagaaacaaaagcctggttaattgctgctgtgaccaaattgacatctcaggcgcactcttctaatacagttgagagattaatccatgaatttaccatatctttggatacttgtatgagacaacatgcatttgaattaaaacatttgcatgagaatgtggaacttatgaagagcttgcttccagttgacaggagttgtgaagacttggtggtagatgcttctttatcttttctggatggttttgtggctgaaggactcagtcagggtgcagcgccttacaaacctccccatcaacgccaggaggaaaagctttctcaggaaaaagttctcaattttgaaccatatggactctccttttcttcatctggcttcactggacgacagtctcctgctggcatttctcttggttcagatgtatctgggaatagtgctgagacaggactgaaagagacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctgctgggaaaagcagatactgtctctcacaagttcagaaggaaatcaaaagtcaaagaagctaaaagtggcgaaacaaccagtactcataatatgacctgttcttcctttagttctttgtcaaatgtggcatatgaagatgattattattcgaatactttgcacgatacaggagacaaggaattaaagaaattttctctcacttcagaacttttggattctgagtcactcacagaactgcccttggttgagaaattctcatattgtagtctgtctacaccttcattgtttgctaataacaacatggaaatttttcaccctcctcaatctactgcagcctcagttgccaaggaaagctctttagcttcatcttttttggaagaaactactgaatacatacactcaaatgctatggaagtctgtaataatgaaactatatcagtgtcttcttataaaatttggaaagatgattgtttattgatggtctggtcagtcactaataagagtggtttggaattgaaaagtgctgacttagaaatttttcctgcagaaaatttcaaggtgactgagcaacctggatgctgtttgcctgtaatggaagcagaaagcaccaaaagctttcaatatagtgtgcagatagaaaaaccttttacagaaggaaatcttactggttttattagttatcatatgatggatactcattctgctcagctggaattttctgtaaacttatcactattagatttcattagaccattaaaaatctcaagtgacgactttgggaaactctggttatccttcgcaaatgatgtgaaacaaaatgtaaaaatgtcagaatctcaagctgcacttccttctgcactaaagactctgcaacagaaactaagactccatattattgagattataggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttgtgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaagggagacatgaaattgataatctcaaacttaattcatatttggctttggaatgtagtgtatggtttttggtagggaagtcaatattttcgattatgttttgcttagatcagtgttgaactaagttggcatagcacacactaacagttgtaggagatccatgagcatgctgga

SEQ ID NO: 104995 - DNA, 4165 bp, Homo sapiens
  Payload ID: 606
  Gene Symbol: AP4E1
  Gene Name: adaptor-related protein complex 4, epsilon 1 subunit
  ENST ID: ENST00000558439
  CDS Start-End: 107-1072
aaaaacaggaagtgcctacggaggccgggccggcagcggcggccgggcatgaagccgggcggctacgggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccctgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaagatcctcagttttaaagagaagtttgaaaaactgttttattgggttagaatactataattctactgcaaataaaatatcttttaaacaggacaagtgaattaatgtatgatgttcttgatgaatccttacgaagagctgagttaaatcacaatgtcacatatgctattttgtttgaatgtgtgcatacagtctattctatttatcctaaatcggaattacttgagaaggctgccaagtgcattggaaaatttgttctgtcacctaaaataaatctaaaatatttaggactgaaggctcttacctatgttatccaacaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaacatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagatttcttcaagttatgagttgggtattaggggaatattcctacctcttagataaggaaacgccagaggaagttatagctaagctctacaagttacttatgaatgactctgtgtcttcagaaacaaaagcctggttaattgctgctgtgaccaaattgacatctcaggcgcactcttctaatacagttgagagattaatccatgaatttaccatatctttggatacttgtatgagacaacatgcatttgaattaaaacatttgcatgagaatgtggaacttatgaagagcttgcttccagttgacaggagttgtgaagacttggtggtagatgcttctttatcttttctggatggttttgtggctgaaggactcagtcagggtgcagcgccttacaaacctccccatcaacgccaggaggaaaagctttctcaggaaaaagttctcaattttgaaccatatggactctccttttcttcatctggcttcactggacgacagtctcctgctggcatttctcttggttcagatgtatctgggaatagtgctgagacaggactgaaagagacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctgctgggaaaagcagatactgtctctcacaagttcagaaggaaatcaaaagtcaaagaagctaaaagtggcgaaacaaccagtactcataatatgacctgttcttcctttagttctttgtcaaatgtggcatatgaagatgattattattcgaatactttgcacgatacaggagacaaggaattaaagaaattttctctcacttcagaacttttggattctgagtcactcacagaactgcccttggttgagaaattctcatattgtagtctgtctacaccttcattgtttgctaataacaacatggaaatttttcaccctcctcaatctactgcagcctcagttgccaaggaaagctctttagcttcatcttttttggaagaaactactgaatacatacactcaaatgctatggaagtctgtaataatgaaactatatcagtgtcttcttataaaatttggaaagatgattgtttattgatggtctggtcagtcactaataagagtggtttggaattgaaaagtgctgacttagaaatttttcctgcagaaaatttcaaggtgactgagcaacctggatgctgtttgcctgtaatggaagcagaaagcaccaaaagctttcaatatagtgtgcagatagaaaaaccttttacagaaggaaatcttactggttttattagttatcatatgatggatactcattctgctcagctggaattttctgtaaacttatcactattagatttcattagaccattaaaaatctcaagtgacgactttgggaaactctggttatccttcgcaaatgatgtgaaacaaaatgtaaaaatgtcagaatctcaagctgcacttccttctgcactaaagactctgcaacagaaactaagactccatattattgagattataggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttgtgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaagggagacatgaaattgataatctcaaacttaattcatatttggctttggaatgtagtgtatggtttttggtagggaagtcaatattttcgattatgttttgcttagatcagtgttgaactaagttggcatagcacacactaacagttgtaggagatccatgagcatgctgga

SEQ ID NO: 104996 - DNA, 6653 bp, Homo sapiens
  Payload ID: 606
  Gene Symbol: AP4E1
  Gene Name: adaptor-related protein complex 4, epsilon 1 subunit
  Uniprot ID: Q9UPM8
  ENST ID: ENST00000560508
  CDS Start-End: 233-3421
agaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgctactggatattttgcttttcagaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccctgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaaggacaagtgaattaatgtatgatgttcttgatgaatccttacgaagagctgagttaaatcacaatgtcacatatgctattttgtttgaatgtgtgcatacagtctattctatttatcctaaatcggaattacttgagaaggctgccaagtgcattggaaaatttgttctgtcacctaaaataaatctaaaatatttaggactgaaggctcttacctatgttatccaacaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagatttcttcaagttatgagttgggtattaggggaatattcctacctcttagataaggaaacgccagaggaagttatagctaagctctacaagttacttatgaatgactctgtgtcttcagaaacaaaagcctggttaattgctgctgtgaccaaattgacatctcaggcgcactcttctaatacagttgagagattaatccatgaatttaccatatctttggatacttgtatgagacaacatgcatttgaattaaaacatttgcatgagaatgtggaacttatgaagagcttgcttccagttgacaggagttgtgaagacttggtggtagatgcttctttatcttttctggatggttttgtggctgaaggactcagtcagggtgcagcgccttacaaacctccccatcaacgccaggaggaaaagctttctcaggaaaaagttctcaattttgaaccatatggactctccttttcttcatctggcttcactggacgacagtctcctgctggcatttctcttggttcagatgtatctgggaatagtgctgagacaggactgaaagagacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctgctgggaaaagcagatactgtctctcacaagttcagaaggaaatcaaaagtcaaagaagctaaaagtggcgaaacaaccagtactcataatatgacctgttcttcctttagttctttgtcaaatgtggcatatgaagatgattattattcgaatactttgcacgatacaggagacaaggaattaaagaaattttctctcacttcagaacttttggattctgagtcactcacagaactgcccttggttgagaaattctcatattgtagtctgtctacaccttcattgtttgctaataacaacatggaaatttttcaccctcctcaatctactgcagcctcagttgccaaggaaagctctttagcttcatcttttttggaagaaactactgaatacatacactcaaatgctatggaagtctgtaataatgaaactatatcagtgtcttcttataaaatttggaaagatgattgtttattgatggtctggtcagtcactaataagagtggtttggaattgaaaagtgctgacttagaaatttttcctgcagaaaatttcaaggtgactgagcaacctggatgctgtttgcctgtaatggaagcagaaagcaccaaaagctttcaatatagtgtgcagatagaaaaaccttttacagaaggaaatcttactggttttattagttatcatatgatggatactcattctgctcagctggaattttctgtaaacttatcactattagatttcattagaccattaaaaatctcaagtgacgactttgggaaactctggttatccttcgcaaatgatgtgaaacaaaatgtaaaaatgtcagaatctcaagctgcacttccttctgcactaaagactctgcaacagaaactaagactccatattattgagattataggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttgtgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaagggagacatgaaattgataatctcaaacttaattcatatttggctttggaatgtagtgtatggtttttggtagggaagtcaatattttcgattatgttttgcttagatcagtgttgaactaagttggcatagcacacactaacagttgtaggagatccatgagcatgctggatattgaggggatccaatctgtgatctattttttattatagataactgttacacataatttcagatcgtttggctgtaaaatttgtctgttttccacttggagttattttaaaattcaaagtaaatcactctattcttattttgaaaactcagagccattttatatagaaacaaaacccataagagcacacagtaacaaagcaaacagatacaaaaatgactttttagttatgacaaatattttagttggttactacttaggtccttttggcaaatgaaaatttgtgattagagtataaatggcaaaactatcttttcctggcctttgaatccactagtacttaatggatatagctgaagcagagactaagtataacatacaggttcttcagtaaaatatatcattttcatgttatagttatgcctgtgtggcctctgtcagaactattatcagtaaaagaggttaagcctatatatgaatgatggaccaaaaccttgaggttgtacattaactgaaatagtattttataaaatcttatggtgctgtggaaaatatttattatttcaccttttctgacacttcaccatggagactattcaggtaatacaattttaagtcattgcagttaatactctggttaattggtactgttaatcacccaggtcaggaattctgattttaggttatctcattaatcatggctgataaagaagctaaggggattctccagatctaatagatttcattagtcatttgtgtcgagtattcctccctaaaaacaaaagcagtattttctttctcaattaatttttaagttattcattaaaaaatatataacatcttaattttattcttttaaaaacatacagtgaagccttgctacaagagtcataagtgactggaatttcttgcataataggttcctccttttgaatagatcagattcatccccaggctctcagcagtgtcatgatgaaatgagtgtgctgacttcaggggtgtggtggacactggtagctagccttatcagctccctccttattcctacctctgtcagcagcatgcctcgccccttacctaattctgctgtgactctgacagagaggaagtgccttctcactttgcaaaggaatgcagcatgtcacaaaggaggtgctccaattttttgtgtccttacttccctatgtttgcctagttactgaggctaggtcgagtgtgaagcaataggtgtaagatgctgagagcacatggacagctaccagggagatctgttgcttggttacagggtgtattcatgagtggtagctgcagttgtcgtgagagacatgcttggcatacagagctgtctaatgggtgggagacatgtaatggtagatttagggctgggagcatgattttgggtctgcccaaaggaacatggtgtcacttttgttctttctgacccactaaataaaaagtagtgtaacagggtttcactggaatgtttattagaaagtttacactttttatatttttatgattttaaaaacaaacaataatagaaaaacagattttaaggaacttcagagcagtatatattctgtctaaactcactgaatattttaagttgtaaatcaggtgtccaccaacctttatttttgcattgcaggagatgtgactgtaaagtagggagtttttttttttgagacagagtttcacccttgttgcccaggctagagtgtaatggtgcaatctccgctcactgcaacctctgcctcccaggttcaagcgattctcctgcctcagcctccctagtagctgggattacaggcatgcaccaccacacccggctaatttttttatatttttagtagagacaaggtttctccatgttggtcaggctggtctcgaactcccgacctcaggtgatctgcccgcctcagcctcccaaagtgctgggattacaggcgtgagccactgcgcccggccaaattatttttgtgggtagattcattctctttacctaatagtcataatttagtcagtgaagggacaacatctggggtaagagctatggaggaggtgctcagctttgtgagttttgtgccaggcatctttgctgaaaatggagatggcagcaagtgtgaatctgggggaatataagggaagacagaaaagccttaagagtagacggaggaagaagggtaccagaatagtccctgtggaggcaggcagatcagagctcagggtttgaaagtgggcctgagtaagggtcctgctagagaaactgcagatggaagctgagcagttaccaactgctaatgtgccaagtataccaagcacagcatgtgtcctgtagaggagcattattttaaacaatgttctactatcatctaccaaaataattgtggtaaaagtgtagtattttattttttccttttatgtcagcaatattttaaaatattgatctgtttatcttatatttttatggataaatgtagtatttgcctcatgattgtgagccactgagagtgcactgaacctattcacatgtctttaagatgttttgctgtgttaaaattttaggagagaaaaatacaagtgaataattatttaataggcatttattactttattttggagttgaattctgtcatttgaaaaagttcagtaatgtaataaatacaaagtgatctgc

SEQ ID NO: 104997 - DNA, 1603 bp, Homo sapiens
  Payload ID: 606
  Gene Symbol: AP4E1
  Gene Name: adaptor-related protein complex 4, epsilon 1 subunit
  ENST ID: ENST00000561441
  CDS Start-End: 108-1214
aaaaaacaggaagtgcctacggaggccgggccggcagcggcggccgggcatgaagccgggcggctacgggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgaagaagaaaaattaatccagcaggaactgagtagtctgaaagcgactgtttctgctcctactacaacactgaaaatgatgaaggaatgtatggtgagacttatatattgtgaaatgcttggatatgatgcttcctttggctatattcatgcaatcaagttagcccaacaaggaaacctcttagaaaaaagagtaggttatttggctgtttccttatttctacatgaaagtcatgaattattgcttctccttgtgaatacagttgtaaaggatctgcagagcactaacctagtagaagtgtgtatggcactgactgttgttagccagattttcccctgcgaaatgattccagctgttcttccattaatagaagataaacttcaacattctaaggagattgtacgaagaaaagctgttctggcattatacaaattccatctcattgctcctaatcaagtacaacatattcatattaagtttcggaaagcactttgtgacagagatgttggggtcatggctgcctccttgcatatatatcttagaatgattaaggagaattcatctggatataaagacttgactgggagttttgtaaccattttgaagcaagtagttggaggaaagctcccagtagaattcaattaccacagtgtgccagcaccatggttacaaattcagctcttgagaatactgggacttctaggaaaagatgatcaaaggacaagtgaattaatgtatgatgttcttgatgaatccttacgaagagctgagttaaatcacaatgtcacatatgctattttgtttgaatgtgtgcatacagtctattctatttatcctaaatcggaattacttgagaaggctgccaagtgcattggaaaatttgttctgtcacctaaaataaatctaaaatatttaggatcctactctggctcttcaacaccagatgacaataattgaatgtttagatcatcctgatcccattattaaaagagagactctggaacttctttacagaattactaatgcacagaatataacagttattgtccagaaaatgcttgaatatttacatcagagcaaagaagagtatgtcatcgtcaatttggtcggcaaaatagcagagctggctgagaaatatgctcctgataatgcatggtttattcagacaatgaatgctgtgttttcagtaggaggagatgtaatgcatcctgatattcccaataactttctgagactactagcggaaggttttgatgatgaaacagaagatcagcaattaagactctatgcagttcagtcttatctcactttactggatatggaaaatgtgttctatccacagagat

SEQ ID NO: 104998 - DNA, 1817 bp, Homo sapiens
  Payload ID: 607
  Gene Symbol: AP4M1
  Gene Name: adaptor-related protein complex 4, mu 1 subunit
  Uniprot ID: O00189
  ENST ID: ENST00000359593
  CDS Start-End: 159-1520
ggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgc

SEQ ID NO: 104999 - DNA, 813 bp, Homo sapiens
  Payload ID: 607
  Gene Symbol: AP4M1
  Gene Name: adaptor-related protein complex 4, mu 1 subunit
  ENST ID: ENST00000394061
  CDS Start-End: 167-361
ctccgggcggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcgggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggccccca

SEQ ID NO: 105000 - DNA, 548 bp, Homo sapiens
  Payload ID: 607
  Gene Symbol: AP4M1
  Gene Name: adaptor-related protein complex 4, mu 1 subunit
  ENST ID: ENST00000450807
  CDS Start-End: 1-483
cgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagaggcctaacatcgtgtcccagctcagccaagcctgcgatggagccataacgagtcgtccagggcgtcttctcgtccacccagctctgtaaggggaaggaaataaactaagatgaaggggtctgaaaggatgattgacagggacctaagtctttca

SEQ ID NO: 105001 - DNA, 678 bp, Homo sapiens
  Payload ID: 607
  Gene Symbol: AP4M1
  Gene Name: adaptor-related protein complex 4, mu 1 subunit
  ENST ID: ENST00000445295
  CDS Start-End: 1-416
ctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaa

SEQ ID NO: 105002 - DNA, 960 bp, Homo sapiens
  Payload ID: 607
  Gene Symbol: AP4M1
  Gene Name: adaptor-related protein complex 4, mu 1 subunit
  ENST ID: ENST00000446007
  CDS Start-End: 57-713
gcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatgttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcag

SEQ ID NO: 105003 - DNA, 1681 bp, Homo sapiens
  Payload ID: 607
  Gene Symbol: AP4M1
  Gene Name: adaptor-related protein complex 4, mu 1 subunit
  ENST ID: ENST00000445208
  CDS Start-End: 159-452
ggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaa

SEQ ID NO: 105004 - DNA, 1091 bp, Homo sapiens
  Payload ID: 607
  Gene Symbol: AP4M1
  Gene Name: adaptor-related protein complex 4, mu 1 subunit
  ENST ID: ENST00000438383
  CDS Start-End: 159-1091
ggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccag

SEQ ID NO: 105005 - DNA, 1836 bp, Homo sapiens
  Payload ID: 607
  Gene Symbol: AP4M1
  Gene Name: adaptor-related protein complex 4, mu 1 subunit
  ENST ID: ENST00000429084
  CDS Start-End: 159-1541
ggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatggtaaccagtggcgggaggcggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcat

SEQ ID NO: 105006 - DNA, 3408 bp, Homo sapiens
  Payload ID: 607
  Gene Symbol: AP4M1
  Gene Name: adaptor-related protein complex 4, mu 1 subunit
  ENST ID: ENST00000416938
  CDS Start-End: 1-580
cttccacccgccagtccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgcatgtgtgtacgtgcacgtgtgtacatgtctgcatgtgtgggaatccgggggctggcaggtggagcatcacggagcaggctgaggggagccggagttgggctgggagccattggcttttggagtccctggagctggagggggactgtccccagcctcctgcttccccccacaaagggcactgccgctgagtggggacggggacgatgccgggggaggaactggagaaggatgggaggtggggcctcctttgccctcccctgttgggggaagtgagaccacgatgtacttctggacactcccaggaccagagggagcagtgctggggggtgcggtggtggcggtggagaccaacttgacgatgggctgcacgctggggacggtggtggtgacgggcgaagtggtggtggaacctgagccgggggccgaggtgctgagggacaggacctggatagaaaggaaaggcaggccgcttgccctgtgccctccctgccccccagaggcctggcgaggacgcttcactcgctccctgcctgaacaagttgttcctgtagttcaccctgtagacagctatggctggagaccttgttcatgcagggcagctacagccctgcaggaccctggtgggcgcctcttccagctcttgacttggggcccagaggggactgtgctctactcctgggcctccccagggtgctctgaggtaacccaggccctccagatgctccctgtcccacagctctgcatacctgctgggtggatggggcgctggaggacgatgacattacaataaacttggttggaggaggggaaggctgtggtggggcagccgctcgtgcagacaccagtgtctggacaggaagtgcgatggagccaggaaccttcagcaagccaggggtgcgagggccaggctgtggggcctgcgagagggtcagcgtgggccggggctgcggggagaagaggaaagggggaagtggcaccatctactaagaagaggagtctgaagggagaggcctgggctcccctcgctcttcctcagtggctctcactagggctggggcatcctcactcagggcctggttgccctgagactactgactgagggcacatgtggctgtgtgcaagtgcctgtcccacacaggggttctcctctgcttcctcctattcctcctccccacccggccacggacctgcgtgatggtcagagtggtcctgttgacctgctgagcctgcagagcagcctgggcccgagccttgaccacctgggagcagaggaggggcccaagggacccgaattctgcccgataggcgtcctgattgtcaggcggtgggcgcagctttgccagaacaggagcacagtgtttctgcagaacagaaaaaaagccaggtagagggagggctggggaaaaaagccaggtagagggagggctggtgacactcttgagaagaaccttggggatggggtaaaaaaggacattccttatcatctcagtgcccctgttgaaggccaaattatgctgaactattagtgtgtgtacagaacactgtgggctttctcataagaaaagatgggcacggggccaggtgcagcatcttaggcctgtatcccagcacttgggaggctgaggtgggtggatcacttgaggtcaagagcctggccaaaatggagaaacctcatctccactaaaaatacaaaaactagccaggcatggtggcacgcacctgtagtcccagctactggggaggttgaggtactagaatgcttgaacccaggtggtggaggctgcagtgagcagaggttgcatcagtgcactcccgcttgggtgacagagtgagactgtctcagaaaaaaaaaaaaaagaa

SEQ ID NO: 105007 - DNA, 1814 bp, Homo sapiens
  Payload ID: 607
  Gene Symbol: AP4M1
  Gene Name: adaptor-related protein complex 4, mu 1 subunit
  ENST ID: ENST00000422582
  CDS Start-End: 571-1548
acttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacatagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcgggcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaa

SEQ ID NO: 105008 - DNA, 1572 bp, Homo sapiens
  Payload ID: 607
  Gene Symbol: AP4M1
  Gene Name: adaptor-related protein complex 4, mu 1 subunit
  Uniprot ID: O00189
  ENST ID: ENST00000421755
  CDS Start-End: 52-1413
gcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgtttctcccttcagcctcctagaactgctctccaggttggccacccttctgggcgattactgtggctccctgggcgaggggaccatctcccgcaatgtggctctggtatacgaactcctggatgaagtgctggactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccggctccaggtttatctaaagttgcgatgtgacctgctctcaaagagccaagccctcaatgtcaggctgcacctccccctgcctcgaggggtggtcagcctgtctcaggagctgagcagcccagagcagaaggctgagctggcagagggagcccttcgctgggacctgcctcgggtgcaaggaggctctcaactctcaggccttttccagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaagaggcctaacatcgtgtcccagctcagccaagcctgcgatggagccataacgagtcgtccagggcgtcttctcgtccacccagctctgtaaggggaaggaaataaactaagatgaaggggtctgaaagga

SEQ ID NO: 105009 - DNA, 921 bp, Homo sapiens
  Payload ID: 607
  Gene Symbol: AP4M1
  Gene Name: adaptor-related protein complex 4, mu 1 subunit
  ENST ID: ENST00000439416
  CDS Start-End: 125-921
agctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagacttccgcggggacagtggcggccgggatgtggccgagctcttctaccggaagctgacgggactgccaggagacgagtccccggttgtcatgcatcaccatggccgtcatttcattcacatcagacacagcggcctctatttggtggtcacaacttcagaaaacgactatggctatgtacagaccacatccacggagatgctgaggaatttcatccagacggaagctgtggtcagcaagcccttcagcctctttgacctcagcagcgttggcttgtttggggctgagacacaacagagcaaagtggcccccagcagtgcagccagccgccccgtcctgtccagtcgctctgaccagagccaaaagaatgaagtttttttggatgtggtcgagagattgtctgtactgatagcatctaatggatccctgctgaaggtggatgtgcagggagagattcggctcaagagcttccttcctagcggctctgagatgcgcattggcttgacggaagagttttgtgtggggaagtcagagctgagaggttatgggccaggaatccgggtcgatgaagtctcgtttcacagctctgtgaatctggacgaatttgagtctcatcgaatcctccgcttgcaaccacctcagggcgagctgactgtgatgcggtaccaactctccgatgacctcccctcaccgctccccttccggctcttcccctctgtgcagtgggaccgaggctcaggccg

SEQ ID NO: 105010 - DNA, 2256 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000216366
  CDS Start-End: 209-688
taaaagccaaaatggctgccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatgtatcctttttcaatactgttttccacagtacttggcaaatgcactctggtccttatcaggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgacttcctgggcccctagaatttataaggtccctagatatcccagaacctgccaccatggcctctgcaagcctctcctccaccttcaccccaagactaggggcaggaatgataagaaggctgggtggtagctgggatgtcccacctacgtgcctggggagagaagcaagagcaggctggagtctctactttgtattcttgtgaggcacaaatataggctagaatccaggccccacaaatataggctagaatccggaatgttttcttgatttaaagacatctttagaccgggcacagtggctcacgccagtaatcccagcactttggagggctgaagcaggaggattgcttgaggccaggagtttgagaccagcctgggcaacatagggagacccagtctctacaaaaaaatttaaaaagccaggcattggtggtgtgtgcctatagtcccaactactagggaggctgaggtgggaggatcacttgagcctgggggactgaggctgcagtgagccatgattgtgctactgcactccaatctggcaacagagcgagaccttgtctttaaaaataaaaataaaaacatctttacaacattcctgtttgtattttataaactcaaaatctcaaagactgagcagttgattctagagccctaaagctctggtgggttgtgtgaaaaaaccctgattcatgtcccttctattgcagttgagggtgggacataggaagggcatcaatgctgtgtgcactctctgtgactccgccagcatctgccatggtgcttcctggagaatgatggtgtgcaggcaacagtgatcagcaccaccatggtttgcagacaggcctcgatcaggcccactgtgggcatctacctctagttccatcagcttcctaaaatctgaaatacttttagagatccggaaaccagaatagggtttctccaagtgggagataatgtcagcctgatttaatgagaaattgcaaaaatacttgttcaaactgaggctataggaataccagccagaagaacaaacaaattcttcagggaagcatccagcactgaagtggcagcttctaaatgaactgaaattttctgcatgttctctcagaaagttacagtgttaattaattaataaaatcattacaaaagaatttcttccgaggtatgatggagcatgtgatgacttcaggaatggcttgatttgtttgtttgtttgtttgtttgttttttgagacagtct

SEQ ID NO: 105011 - DNA, 839 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000313566
  CDS Start-End: 390-839
aaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatgtatcctttttcaatactgttttccacagtacttggcaaatgcactctggtccttatcagacaaggtcttgctctgtcacccaggctggagtgcagaggtgcgatcatggctcactacaccctggatctcctgggctcaagtga

SEQ ID NO: 105012 - DNA, 1122 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000334725
  CDS Start-End: 192-641
gccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatgtatcctttttcaatactgttttccacagtacttggcaaatgcactctggtccttatcagacaaggtcttgctctgtcacccaggctggagtgcagaggtgcgatcatggctcactacaccctggatctcctgggctcaagtgatcctcctacctcagcctcccaagtagctgggactacaggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgact

SEQ ID NO: 105013 - DNA, 4243 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000542754
  CDS Start-End: 394-828
ggaaaaggggggtaagatgcctatcctagtccctctcttcgggctcttcatctcaagaggaacaaacaagagcaaactcagtgttgagaggccccaaaccggactctcccacagagaggtgctcggtcccaagccccggaggcccgggaaggccgcctccggaggagcccccgcagacgccatactaaaagccaaaatggctgccccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaaggcattttgagtaacgctgttttctgaaagctatttttttttttttgagacggagtctagtctagctgtgtcacctggcacattctcggctcactgcaacctccacttccggggttcaagcgattctcctgcctcagcctccgagctgggactacaggcatgcaccaccacacctggctaatttttgtatttttagtagagacagggtttcaccatgttggccaggctgtctcaaactcctgacctcaggtgatctgcctgcctcagcctcccagaacgctgggattacagatgagccacagtgcctgacttctgaaggctgtcttattcctttaaaaggcttagtaaaattaactttttaagaggtgtttttttgtttgtttttttgttttgttttttaagacggagtcttgctctgtcacccaagctggagtgcagtggtgtgatctcagctcactgcaacctccacctctgggtttaagcaattctcctgcctcagcctcctgagtagctgcgactacaggcatgtagtccccaggagactgagctgtgattacagatgtgagccaccatgccctgcccggttttatgtaaagcccagctaatttttgtatttttagtagagatagggtttcaccatgttggccaggctgttcttgaactcctgacctcaagtgatccacctgcttcagcctcccaaagtgctgggattacaagcatgagccaccatgcccagccaagaggtgttttttgtttgtttgtttttaagagaagcaggtcttgctgtgttgtccaggctggactgcagtggcttttcacaagcatgatcatgttgtactacaaccttgaaccttcctggcctggctctaaaagctttgtaatgtggggctggtgcagtgcctcacacctgtaacccctgcactttgggaggctgaggaaggaggatcgcttgaggccagaaattcaagaccagcctgggcaacatagacctcatctctacaaaaaatgcaaaaatcagccgggtgtggtggcacatacctgtagtctcaactactcgggagtctgaggcagaagatttcttgagcccaggagttcgagtctgcagtgagctatgatcgtgtcactgcactccagcctgggtgacagagtgaaaccctgtctcaaaaataaaaaagtccgagtgcggtggctcaggcctgtaatcccaacattttggggggccaagccaggaggattggttgagcccattagttcaagaccagcctgggcaacacagcaagaccatatctctacaaaaaataaataggtgtgatggctcatgcctgtaatcctagtactttgggaggccgaggcaggcagatcacttgaggtcaggagtttgaaaccagcctggccaacatggcaaaaccttgtctctactaaaaatacaaaaagttagccaggcatggtggcaagcacctctaatctcagctactcaggaggctgaggcagtagaattgcttgaacccgggaggcagaggttgcagtgagccgagatcatgccactgcactccagcctgggcgacagagtgagaccctgtctctaaaaataagtaaataactaattaaaaagttagccagctgtggtggtgagcacctgtactcctaactactcaagaggctgagatgggagaattgatcaagcctaggagtttgaggctgcagtgaactatgatcacaacactgtactccaacctgggtaatggagtgaggccctgcctcaaaaacacaaaaacaaaacaaaaaaacttttataacatgtacctaacaaagatgcagagttaaattttatttgccagtttgtaaaagcctttgatactcattttaagggcacttagtaattacaatgccattatgtaattaactctatagagaacattactttcaaataatggatggtcagacattaagacagccccagagagcccctacagctatcctttatcccgttttttgtttgttttttggagacagcatctccgtctcctaggctggagtgcagtggtgtgatcatgcctcactacagcctgtacctcctgggctcaggtgctcctcccacctcagcctcctgagtaactgggaccacaggtgcgcaccccctccacccagctaatttttgtattttgttgtagagatagggtttcactatgttgcccagactggtctcgaattcctgcagtcacatgatccatctgccttcgccttccaaagtgttgggattacaggcctgagccactgtgcccagtctttttatgccacattttaaaaggtttgcttattaataagcttactgttaatgaaatttagttcaaagtttaaaagtagaatgcagccaggcatggtggcttacgcctataatcccagcactttgggacgccaaggtgggtagatcatttgaggtcaggagttcaagaccagcttggccaacatggtgagaccctgtctctactaaaactacgaaaaattagccgggcatggtggcacgcgcctataatcccaactacttgggaggctgtggtaggaggatcacttgaacccaggagacagaggttgcagtgagttgagatcgagattgtgccactgcactccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgca

SEQ ID NO: 105014 - DNA, 1491 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000554345
  CDS Start-End: 177-584
gcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtggaaccaattgatgaacttcccaaaatatgctcagccctggagccccagcagacttgcttttctccagacagttcatcattcaaaggagctgcctccaccacccccatctactgaatagccaggggagggcaccaatgaacagcacagtatgggagacacaccaactactcttcaaatcagtgcgtacctgctctacgcgtgaaggtacagaaaacctccacggccttttcagtatttggtgcctttaaagaggcctaaggacttagtttatttgggctagactggaatgcagcagtactgccttcaggcctggacagccaggggctcctcgggccctgtgctctagaaggcccattctatgtctgcttcgccagcaccctttccccatcatggggcagatgcccaccagccctcactatctactgcttgaccatcctctgacttcctgggcccctagaatttataaggtccctagatatcccagaacctgccaccatggcctctgcaagcctctcctccaccttcaccccaagactaggggcaggaatgataagaaggctgggtggtagctgggatgtcccacctacgtgcctggggagagaagcaagagcaggctggagtctctactttgtattcttgtgaggcacaaatataggctagaatccaggccccacaaatataggctagaatccggaatgttttcttgatttaaagacatctttagaccgggcacagtggctcacgccagtaatcccagcactttggagggctgaagcaggaggattgcttgaggccaggagtttgagaccagcctgggcaacatagggagacccagtctctacaaaaaaatttaaaaagccaggcattggtggtgtgtgcctatagtcccaactactagggaggctgaggtgggaggatcacttgagcctgggggactgaggctgcagtgagccatgattgtgctactgcactccaatctggcaacagagcgagaccttgtctttaaaaataaaaataaaaa

SEQ ID NO: 105015 - DNA, 663 bp, Homo sapiens
  Payload ID: 608
  Gene Symbol: AP4S1
  Gene Name: adaptor-related protein complex 4, sigma 1 subunit
  ENST ID: ENST00000557346
  CDS Start-End: 265-663
aaatctcttcagtcgtttcataaatacagcatcgatcgtctggtttggtttttttatagataaagaaacggatgggggaaaggagatctagtggagagtactgtaaaaagaaaaattcagtgctgaaagcgttgatgagtcactaagtaaggaataactacagagaatccaagtgagtaaggcagcatctcaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcc

SEQ ID NO: 105016 - DNA, 769 bp, Homo sapiens
  Payload ID: 608
  Gene Symbol: AP4S1
  Gene Name: adaptor-related protein complex 4, sigma 1 subunit
  ENST ID: ENST00000555417
  CDS Start-End: 747-769
gccgcagctaccggacacctgggctccgactctgacttttggaagcgaggcggccttaggcttcctggttatcagtttccttttagcaggccgtccccgggcgctgtttccttcccaggggtctctcacccgtgtcccggctttctgagctggttgttaacctggctggtcgctctggccgaccgcatcccgtctcggattcctgacgtttctttttcattctttgagtgtttcaggcagtcccaagggtgggccctctttcccttcctgtcactcgctctgcctctggtttcttagaaccagtcagttctctgctggcaaatagccaagatcctccggctgtggttactgattcctcgtctctgtcttgagcctgggctttggtcccatttctatgcgctcggtcgcccgtcgtaacttattccactttgcgtcccctcttctttccttttctggaatgggttgtgggggggttgggagagggggaggagcgattttttttttcttgggagaagaagaggtagtgaattcctttagatcttgacgatgatgggtagagggagagaagtttgaaggagactggctagactaacaatttgatacggtagaaatgaatgggctcacaaatattgtcatcaatagactattttgatcgaaacagaaaataaaagcactgttccagttacagccatcccttgtcataacttttgaactgtatttggaaaaatactggccaggaaagaaaaatgataaaatttttcctcatggt

SEQ ID NO: 105017 - DNA, 407 bp, Homo sapiens
  Payload ID: 608
  Gene Symbol: AP4S1
  Gene Name: adaptor-related protein complex 4, sigma 1 subunit
  ENST ID: ENST00000556480
  CDS Start-End: 1-252
gaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtggtaagtctaatggctaaaaaatggtttacttcctcaacccagtttcccagaaattgagtctctttggatctatatcaagaacatgtgttaatacagagttttaataagtaaaagttaaaacttaagtgatgccaaattttctttatctttccttctggtttatccaaagtgttacaagcctatacatgcctgagatctttataaagaactgg

SEQ ID NO: 105018 - DNA, 542 bp, Homo sapiens
  Payload ID: 608
  Gene Symbol: AP4S1
  Gene Name: adaptor-related protein complex 4, sigma 1 subunit
  ENST ID: ENST00000556232
  CDS Start-End: 249-542
atactaaaagccaaaatggctgccccgaggaggcccgcaccgcgtagccagtgaaggttggggagcaagcttatgcgggaaagagggagggggactccaggaaaagccgttgagaggaccatcacaacctgagcagcacagtgaagaaagaaagctgaagagctcttggtcacttcagttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtg

SEQ ID NO: 105019 - DNA, 1012 bp, Homo sapiens
  Payload ID: 608
  Gene Symbol: AP4S1
  Gene Name: adaptor-related protein complex 4, sigma 1 subunit
  ENST ID: ENST00000554609
  CDS Start-End: 189-497
ccgaggaggcccgcaccgcgtagccagtgaaggttggggagcaagcttatgcgggaaagagggagggggactccaggaaaagccgttgagaggaccatcacaacctgagcagcacaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtggtaaataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaa

SEQ ID NO: 105020 - DNA, 4595 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000616371
  CDS Start-End: 747-1181
gccgcagctaccggacacctgggctccgactctgacttttggaagcgaggcggccttaggcttcctggttatcagtttccttttagcaggccgtccccgggcgctgtttccttcccaggggtctctcacccgtgtcccggctttctgagctggttgttaacctggctggtcgctctggccgaccgcatcccgtctcggattcctgacgtttctttttcattctttgagtgtttcaggcagtcccaagggtgggccctctttcccttcctgtcactcgctctgcctctggtttcttagaaccagtcagttctctgctggcaaatagccaagatcctccggctgtggttactgattcctcgtctctgtcttgagcctgggctttggtcccatttctatgcgctcggtcgcccgtcgtaacttattccactttgcgtcccctcttctttccttttctggaatgggttgtgggggggttgggagagggggaggagcgattttttttttcttgggagaagaagaggtagtgaattcctttagatcttgacgatgatgggtagagggagagaagtttgaaggagactggctagactaacaatttgatacggtagaaatgaatgggctcacaaatattgtcatcaatagactattttgatcgaaacagaaaataaaagcactgttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaaggcattttgagtaacgctgttttctgaaagctatttttttttttttgagacggagtctagtctagctgtgtcacctggcacattctcggctcactgcaacctccacttccggggttcaagcgattctcctgcctcagcctccgagctgggactacaggcatgcaccaccacacctggctaatttttgtatttttagtagagacagggtttcaccatgttggccaggctgtctcaaactcctgacctcaggtgatctgcctgcctcagcctcccagaacgctgggattacagatgagccacagtgcctgacttctgaaggctgtcttattcctttaaaaggcttagtaaaattaactttttaagaggtgtttttttgtttgtttttttgttttgttttttaagacggagtcttgctctgtcacccaagctggagtgcagtggtgtgatctcagctcactgcaacctccacctctgggtttaagcaattctcctgcctcagcctcctgagtagctgcgactacaggcatgtagtccccaggagactgagctgtgattacagatgtgagccaccatgccctgcccggttttatgtaaagcccagctaatttttgtatttttagtagagatagggtttcaccatgttggccaggctgttcttgaactcctgacctcaagtgatccacctgcttcagcctcccaaagtgctgggattacaagcatgagccaccatgcccagccaagaggtgttttttgtttgtttgtttttaagagaagcaggtcttgctgtgttgtccaggctggactgcagtggcttttcacaagcatgatcatgttgtactacaaccttgaaccttcctggcctggctctaaaagctttgtaatgtggggctggtgcagtgcctcacacctgtaacccctgcactttgggaggctgaggaaggaggatcgcttgaggccagaaattcaagaccagcctgggcaacatagacctcatctctacaaaaaatgcaaaaatcagccgggtgtggtggcacatacctgtagtctcaactactcgggagtctgaggcagaagatttcttgagcccaggagttcgagtctgcagtgagctatgatcgtgtcactgcactccagcctgggtgacagagtgaaaccctgtctcaaaaataaaaaagtccgagtgcggtggctcaggcctgtaatcccaacattttggggggccaagccaggaggattggttgagcccattagttcaagaccagcctgggcaacacagcaagaccatatctctacaaaaaataaataggtgtgatggctcatgcctgtaatcctagtactttgggaggccgaggcaggcagatcacttgaggtcaggagtttgaaaccagcctggccaacatggcaaaaccttgtctctactaaaaatacaaaaagttagccaggcatggtggcaagcacctctaatctcagctactcaggaggctgaggcagtagaattgcttgaacccgggaggcagaggttgcagtgagccgagatcatgccactgcactccagcctgggcgacagagtgagaccctgtctctaaaaataagtaaataactaattaaaaagttagccagctgtggtggtgagcacctgtactcctaactactcaagaggctgagatgggagaattgatcaagcctaggagtttgaggctgcagtgaactatgatcacaacactgtactccaacctgggtaatggagtgaggccctgcctcaaaaacacaaaaacaaaacaaaaaaacttttataacatgtacctaacaaagatgcagagttaaattttatttgccagtttgtaaaagcctttgatactcattttaagggcacttagtaattacaatgccattatgtaattaactctatagagaacattactttcaaataatggatggtcagacattaagacagccccagagagcccctacagctatcctttatcccgttttttgtttgttttttggagacagcatctccgtctcctaggctggagtgcagtggtgtgatcatgcctcactacagcctgtacctcctgggctcaggtgctcctcccacctcagcctcctgagtaactgggaccacaggtgcgcaccccctccacccagctaatttttgtattttgttgtagagatagggtttcactatgttgcccagactggtctcgaattcctgcagtcacatgatccatctgccttcgccttccaaagtgttgggattacaggcctgagccactgtgcccagtctttttatgccacattttaaaaggtttgcttattaataagcttactgttaatgaaatttagttcaaagtttaaaagtagaatgcagccaggcatggtggcttacgcctataatcccagcactttgggacgccaaggtgggtagatcatttgaggtcaggagttcaagaccagcttggccaacatggtgagaccctgtctctactaaaactacgaaaaattagccgggcatggtggcacgcgcctataatcccaactacttgggaggctgtggtaggaggatcacttgaacccaggagacagaggttgcagtgagttgagatcgagattgtgccactgcactccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgc

SEQ ID NO: 105021 - DNA, 4113 bp, Homo sapiens
  Payload ID: 608
  Gene Symbol: AP4S1
  Gene Name: adaptor-related protein complex 4, sigma 1 subunit
  Uniprot ID: Q9Y587
  ENST ID: ENST00000622409
  CDS Start-End: 265-699
aaatctcttcagtcgtttcataaatacagcatcgatcgtctggtttggtttttttatagataaagaaacggatgggggaaaggagatctagtggagagtactgtaaaaagaaaaattcagtgctgaaagcgttgatgagtcactaagtaaggaataactacagagaatccaagtgagtaaggcagcatctcaggttccagttacagccatcccttgtcataacttttgaactgtatttggaaaaatactggccaggaaagaaaaatgataaaatttttcctcatggtgaataaacaagggcagactcgactttctaagtactatgaacatgtggatattaataagcgtacacttctggaaacagaagtcataaagagctgtctctctcgatccaatgaacaatgctctttcattgaatataaggattttaagctgatatatcggcagtatgcagctctcttcattgtggttggagttaatgacactgagaacgagatggctatttatgaattcattcataactttgtggaagttttagatgagtatttcagccgagtgagtgaattagatataatgtttaatttggataaagtacacatcattttggatgagatggtgttaaatggctgcattgtggaaactaacagggcaagaattcttgcccctctactaattcttgataagatgtcagaaagctgaaaggaagtctcttcgagacaatatggatttatcagaaatgcgagtaccgtggaatacatctcaacatgttaacccagaagaatctggaagaccacaattacaaaatggggtatccttccaaagacattataaataggcattttccacagttcctaaaaagaaaacacaactgtactttaaaatatgtacaaagaaaaaaatttctttaaactgagagagaagttttattttctaattgtaaacatatctgtcgcactttaaattctgttgagcacctaaggaacccttcttggtctatgcttcttttgcaaattgaattcaggaatagcaggatggtagtgggaagaaagtatggcagttttccgtcagccaataaagttttaaaatttaaacacaaggcattttgagtaacgctgttttctgaaagctatttttttttttttgagacggagtctagtctagctgtgtcacctggcacattctcggctcactgcaacctccacttccggggttcaagcgattctcctgcctcagcctccgagctgggactacaggcatgcaccaccacacctggctaatttttgtatttttagtagagacagggtttcaccatgttggccaggctgtctcaaactcctgacctcaggtgatctgcctgcctcagcctcccagaacgctgggattacagatgagccacagtgcctgacttctgaaggctgtcttattcctttaaaaggcttagtaaaattaactttttaagaggtgtttttttgtttgtttttttgttttgttttttaagacggagtcttgctctgtcacccaagctggagtgcagtggtgtgatctcagctcactgcaacctccacctctgggtttaagcaattctcctgcctcagcctcctgagtagctgcgactacaggcatgtagtccccaggagactgagctgtgattacagatgtgagccaccatgccctgcccggttttatgtaaagcccagctaatttttgtatttttagtagagatagggtttcaccatgttggccaggctgttcttgaactcctgacctcaagtgatccacctgcttcagcctcccaaagtgctgggattacaagcatgagccaccatgcccagccaagaggtgttttttgtttgtttgtttttaagagaagcaggtcttgctgtgttgtccaggctggactgcagtggcttttcacaagcatgatcatgttgtactacaaccttgaaccttcctggcctggctctaaaagctttgtaatgtggggctggtgcagtgcctcacacctgtaacccctgcactttgggaggctgaggaaggaggatcgcttgaggccagaaattcaagaccagcctgggcaacatagacctcatctctacaaaaaatgcaaaaatcagccgggtgtggtggcacatacctgtagtctcaactactcgggagtctgaggcagaagatttcttgagcccaggagttcgagtctgcagtgagctatgatcgtgtcactgcactccagcctgggtgacagagtgaaaccctgtctcaaaaataaaaaagtccgagtgcggtggctcaggcctgtaatcccaacattttggggggccaagccaggaggattggttgagcccattagttcaagaccagcctgggcaacacagcaagaccatatctctacaaaaaataaataggtgtgatggctcatgcctgtaatcctagtactttgggaggccgaggcaggcagatcacttgaggtcaggagtttgaaaccagcctggccaacatggcaaaaccttgtctctactaaaaatacaaaaagttagccaggcatggtggcaagcacctctaatctcagctactcaggaggctgaggcagtagaattgcttgaacccgggaggcagaggttgcagtgagccgagatcatgccactgcactccagcctgggcgacagagtgagaccctgtctctaaaaataagtaaataactaattaaaaagttagccagctgtggtggtgagcacctgtactcctaactactcaagaggctgagatgggagaattgatcaagcctaggagtttgaggctgcagtgaactatgatcacaacactgtactccaacctgggtaatggagtgaggccctgcctcaaaaacacaaaaacaaaacaaaaaaacttttataacatgtacctaacaaagatgcagagttaaattttatttgccagtttgtaaaagcctttgatactcattttaagggcacttagtaattacaatgccattatgtaattaactctatagagaacattactttcaaataatggatggtcagacattaagacagccccagagagcccctacagctatcctttatcccgttttttgtttgttttttggagacagcatctccgtctcctaggctggagtgcagtggtgtgatcatgcctcactacagcctgtacctcctgggctcaggtgctcctcccacctcagcctcctgagtaactgggaccacaggtgcgcaccccctccacccagctaatttttgtattttgttgtagagatagggtttcactatgttgcccagactggtctcgaattcctgcagtcacatgatccatctgccttcgccttccaaagtgttgggattacaggcctgagccactgtgcccagtctttttatgccacattttaaaaggtttgcttattaataagcttactgttaatgaaatttagttcaaagtttaaaagtagaatgcagccaggcatggtggcttacgcctataatcccagcactttgggacgccaaggtgggtagatcatttgaggtcaggagttcaagaccagcttggccaacatggtgagaccctgtctctactaaaactacgaaaaattagccgggcatggtggcacgcgcctataatcccaactacttgggaggctgtggtaggaggatcacttgaacccaggagacagaggttgcagtgagttgagatcgagattgtgccactgcactccagcctgggcacagagtgagattccgtctcaaaaaaaaaaaaaaaaaaaaaagtagaaagcaagaaagtgtctctgtacaggtaggcatgaaatgaatccttctcttcctcccctttactcctttaaccccttctcctgcaatgtcttgaagtaaattactgtcattacagaagagcaatgcactgcatccccccaaaacctttctatatgcttttgctaccccgttaacagaagaatatacagaactgtcttaggcgaaagtatgtacagtagtccctctcttatccactgtttcgcattctgtggtttgtgttactcatggtcaactgaggtcccaaaatattaaacagaaaattccagaaataaacaatgtataagttttaaactgc

SEQ ID NO: 105022 - DNA, 4811 bp, Homo sapiens
  Payload ID: 609
  Gene Symbol: AP5B1
  Gene Name: adaptor-related protein complex 5, beta 1 subunit
  Uniprot ID: Q2VPB7
  ENST ID: ENST00000532090
  CDS Start-End: 212-2848
ctgtcctgtcccgcgagggccccggcgcccagctctggcgtcggccccgagagccctggtctcaccgtgggagccgggcgcgggtcccgccggcatctgcgcggcgtctgggggtgaccgcagcccctcggggtcggcagcgggccccgcgctcccggtggctgcggcctgagggtccctcttccctgcgcaggggcccgcgcgcctcaccatggggcccctgagccgggacgcctgggcccagcgcttgggggccttccgggccagcccgtctgccttcatggcaggtcccgagggggaggatttgggtcgcgacctgctgagcgacctgagaagtgagaagctgagcgaacagaccaaggtttccctgctggccctgagcatggagtaccctgcgcagctgtggcccgacgcctctgcggccgaagtggccgccacctccctgttggacaccttggtcctcctacccccgcggccctcagctctccgtcggccactgctgctggcggccaccactgccctggcggcgggcggcgcgctgggccccacctcgggcgcctcctgccggctcctgcccctactgctcggcctggccgcgggtagcgatctggggcgaggctttgtccccgcctcggaacagcgccccttgcaggccacggcctgcgagtgcctgcgagagctagagagctgcaagcccgggctgctggggggctccctggggttgctgcggggcctgctggggcaggaaggccctgtccagccactcagcctgttgctggccctcgctttgcgcaacaccttggtgctccagtcccgggttggggctggcctggggggactgctcacggataaggtctccccaactgggggtggtccctgggattggacactagtggaggagggcgatggacgccttcagccccaggcacccagctggccggcagctgaggagggagagggggagcgtagccttacagcacgagagcacagccctgaggaggcgcgggagctgcgggctgcggtgatccagcttctggacacctcctatctgctcactcctgtggcccaggcccagctcctgtggctgctgggctgggccctgcggggtctgcagggacagccaccggcactcttcaagccgcagctggtacggctgctaggcacagcacagctgacactgttgcacgccatgcttgcgctcaaggcggcctttggtgaggccttgttcacagcccaggatgaagcgttgctgctccgccggctcaccttggctgcccagcaccctgctctgcctccgcccacccatctcttttaccttcactgcgtcctgagcttccctgagaactggccgctgggccctgaaggtgaggaggctgccccactgctgctagggccccagctatgccgtggtctcctgcccagtctcctgcatgacccaatggccctcctggcccgcctgcatttactgtgcctgctctgtgccgaggaggaagaagaggagaaaggccagcttccaagcccacggcactacctggaagagctgctggctggcttgcggcagcgggcagccctggatgggggcccccgggccttggccactctctgcttccaggcctcgtatctggtggcctgctgcctggctgggcaacctacggtgctgacccccttgatccacggactggcccagctgtaccaagcccggcccatgctggctccccactttgtggacctcttggatcaggtggactctgagctgagggagcccctgaaggtggtgttgcggcaggtggtggtgtccaggccgggcagggatgaagctctttgctggcacctgcaaatgctggcaaaggtggcagatggagatgcccagagtgctaccctcaactttctacaggccgcggctgcccactgcacgaactgggacctacagcagggcctgctgcgggtctgccgggcgctgctgcgggcaggggtgaggggcggcctggtcgacttgctgcaggtgctggccaggcagctggaggaccctgatgggcgtgaccacgcccgcctctactacatcctgctggcacacctggcagcacccaagttgggggtggccctgggcccctcgcttgccgcacctgcactggcctcttcactggtggccgagaaccagggctttgtggcagcactgatggtgcaggaggcaccggccctggtacggctgagcctggggtcccatcgggtcaagggcccactcccagtgttgaagctccagccggaggcgctggagcccatctactctctggagctgcgcttccgtgtggaaggacagctgtatgcacccctggaggctgtccatgtgccctgcctgtgtcctggccgccctgcccgccctctgctcctgcctctgcagccccgatgcccggcccccgcacggctggatgtccatgccctttacaccacatccactggtctcacgtgccatgcccacttgccacccctgttcgtgaactttgccgacctctttctgcctttcccgcagcctccagagggggccgggctgggcttctttgaggagctctgggattcctgcctgccagagggtgctgagagtcgtgtgtggtgtccacttgggccacagggcctggagggcttggtgtcccgccacctggagccttttgtggtggtggcccagcctcctaccagctactgtgtagcaatccacctgcccccggactcaaagctgctgctgcggctggaggcggccctggcagatggagtgcctgtggccctgcggaccgatgactgggccgtgctgcccctggcgggggactacctccgtgggctggcggctgctgtctgagccccgggagaccaggtgggggcaggactgtggcccttgtgggggccaaggcacactcctgtagctctgtcgccaaaaccctgcattccgcagtgccctcgctggcttgttttcttttgggccccggttgggagcaggctcctgggggtgagggtctgtctgagtctgtttttgctgctctagcaagatccctgagacggggtaagttataataaacagaaatgtattggctcagagctctggaggctgggaagtccatagtggagggcccagagcccagtgaggacccttctgcatcttcccatgacagaggacagagtgacaggagtgaggggagagagcgaacccactcccaagataacggcctgagtccacgcaggagggcagagccctcgtggcctgaccacctcttagggtctaatcttatactgttacagtggcaatcgcatttcaacgtgagcgtgggaggggacaaacattcaaaccatagcagggtcataggccccaagaaggcttccagacagaacccggcactgtagagctacagagttccttctcacccagacacactagtgctctccagaatctctgcccaggaggcaggggaaaaatctcctttctgcttcccagagagggtctggccttgcccaaggccactcagtgatttaggaagaaggctgaagctagagtgtggacctgacctgttggacagtacttttctttctttttttttcggggaggggttaaagacaggatctcactctggcgctctggagtgcagtggtgtgattagggatcattgcagactctgcctctcaggctcaggtgatcctcccatctcagcctgcctccgagtagctgggactacaggtgtgagtcaccactgtattttttgcagacaggatctccctgtttcctaggctggtctcgaactcctgggcttaaatgactcttctgcctcagcctcaccaaagtgttgggattactggtgtgagcccccacacctggccgagccagcgcttctcaactcccaaggtttgcaagctccctgccccagggagctcacgccaggcaggccagtgggcctaagccagaaacagaaagacagcagtggccaggtggagagcttcccaagctgtgccgattagagccagctctaggaagggcctgctaataaggtctagggtctgagaccaagttttttctaatctcagcccctaagaaacctaatttgtgcttaggaatcttcccaggtaagaagaactagttcctctagttgttgtttttttttcccaaacatgcaaacactgaggattgagctgtgtggggtcagctgtgctgccaggcacatgtacgttgcctcatttcatccttgcaacagctctgcagggccccgcagatgaggaaatccgtaggcaggagcggttgagtgattttcctaaggtcacccagctgtttggtaatagtgttttgtcatctggtagcaggtttccattaccatgccatcagagcagacctcagccagggccacagaggtcccaaccgtctctgccctcttctgctgcccctgcctcatgggctcccagccacaggttccccatgggccagctttacgcctcctgatccttccgattggggcagactaggagaggaaagacgggcctgggctgggtgcggtggctcatgcctgtaatcccagcactttgagaggctgcggcgggtggatcacctgaggccaggtgtttgagatcagcctggccagcatggcgaaaccctgtgtctaataaaaatacaaaaattagccgggcgtggtggcgggcgcctgtaatcccagctacttgggaggctgaggcaggagaattacttgaacctgggaggcagaagttgcagtgagccgagatcacgccactgcactccagcctgggcgacagagcaaggctctgtctcaaaaaaagaaaaaaaa

SEQ ID NO: 105023 - DNA, 11737 bp, Homo sapiens
  Payload ID: 610
  Gene Symbol: AP5M1
  Gene Name: adaptor-related protein complex 5, mu 1 subunit
  Uniprot ID: Q9H0R1
  ENST ID: ENST00000261558
  CDS Start-End: 407-1879
cgcgccagggaggttgtcgggaggggccggcgaataaaacgagcggcgaaagaaccgaaaaaaggctcgacgctaccgtgtatgaggaactttgatccttgcgggccaccattccggaagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctgtgagtgaaaaatcactgaatgatttaattgtaaaagtagtcttatgtggtgtttgtagtctgatagagcttgaaaggacattttaaaagctaatgtctccaattttgttaaccttcgattttatgccagtataattcagaacatagaaaagtaatgattcacttgggctcattttagactggtcctgggtcaccctgccacacttgtttcctagtgtttctgtggcagacattgctaatcaattacagcccttttctgtactgagccttggataaagggtcaggctcctttttagttcagagattcaggcagccactcccagtgggttgtagataatgtgcaagataaaaactattttctcttccaaatctaagtactaagctcctagtataaggtgttgttacagaataccagagaccatgttagagacaactacatctcttcaaaaaacagccaacagagacaaaggaaaagtgtttaaatagtaagctgttcttcttaatcagaactatcctattgactaataaataatctgcataattctacttaaggtgtgtaatctctgttctagagttagtttttaagtaagcttgttaatctgccactttgacattttgcttaggatgtcagtagccatattaagatgtgtagaataccttcagaagatgatcatagtgttttgtaatcatttaatgtctgcagccaaatttttaaaggtaatttagacctaatactgctcttgctgtgtcttattaagttaaaattaatgaatgaattctggtaaaaattcaaaaggcactctgtgagtagagagtatcatttaagcttattttagtcacatgtagtatatatctccttaaagctgtcactctcactttcttaccattctcttgatttcttcagaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttgattatatcttgggttctgttttttaatgagtgttctaaggaaaagcttagaaaagctgctaactcctcagaagaaagcatgatagtttaaaggtatagggcatataaatttaggatttgaaatatgattttttaattaaggtcagtcctactcataaactcattttctgcaaagcattatcatggcataaggttctatgttcaaaattatcccaagtaacaaagaaaaaaagaataactgcctgaccaggattttaacttgttattctagcttaatcatagataatcagcagtgaaaactttccttttgaaagaagaaaatatcattccctataagttatttgatctctcttaaactcaaagcttaacatttcacttatgttgataagttaatggtaatggagccatttggaatcttgattgtataaatgtttaccaaatacactaaggtaagcaagaggcatttatctagtgagtaggcaaagatttaatataataatcccctaggcaaaagtttataagcagttagaaaaatcagtgaatcttctatttgacatttctagaaaccggaggaaaatctagggtgtcctggaaaagtgatgaggtgttggggaacctgatgccatctgttgccattccattctaacatagtgctacagaactgaaccaacttaggttttcatcccattgagatcagctgggcacactgtgatgcttttgattttgtctagaaacctgtcacttcaggataatttctgaagacaaagtctgtttcccgtttggtaggtgacctgtttaatgttttccctgtgtctgggaactccttagtgtaattagcgacctttgaactccacaactaatcctgagctattttgtattccttactcatctttaaggctggacctttcctttcttcagagtccgttgccacaattaaagaagaaacagctgcatttcaaagggattccgattccagaagcttaatcgtgattgacatgttcttattctaagctataagacactctaagagtcctttcttgggttaaaacttcaatcattttctaaaaaattatctcactatggattttattcattttctttgataactattctttgcattttttaacttgaaagatgctttgcgtttgcagtgaatatgagcaactacttccagtgaaagatttggatagtgtcagaccttctctagatgcaaaattgctaaattcccttttagtgccaaaatatgattatgaaatctgatgtctatcacataggtaattattcttcaataaactcgaaaggttaaaaaaaaaagtgttaattttttagaatgaactccagaaaagatcgttcatgattttgtaaacgcttcttttctccattttttactaaacaatattttaaaaactttttagagccagcaatatagtacttaggcaatacccttacggtggtggcaatttttttttaactttttaagtaattgattcaaatgtcaagtttgaagcagtcttgtcaggaattctgatgacaattatttgtttaaaaaattttttttattaaacattagtctgtcccataaaatcgttttcatttttttcacaccaattcagtatttctactaggttaaaattatggtgtttttatacattgtatgatttaagatctttcaaggcagacatttatacttggtaacaattgccaatttttttttctggtttttgttgtagtatttcaaaatacttcgtagacattgatagactcctacactacccctgggagctaggtaggtggaattatcatccaggccttctgtagggactgctgccacaacagagtggttgttcctaagacaaaggtcaaaaaaaggggtgttaataaacagtcctcaggtttaagggacttttttaggattacatcttaaattccaacaaatcagatttaggagttactgaaagtgaaattgatccatccctcatccaaactttgcaatactttcctgttctgacatcatttagatagttagctgtattatcagattagaaaccattgtaccaggctgctgaaaggaaaaggaggcaaaaagctaaacatgggatgaattctgaaccttttaacctggctgaagtacgttggtccctgttatgcaaataccttcaatcctctgctaagttcagtggaaataattttcttgaatgacaggtttattcagcaaggattcagttggtgattaatccccctttgatctagggtatttcacttaactaccagttacctcgttctgacaaagtgcaactgagattagggagatcactagaacactaccagggtgtgcgtttattctctataaccttttaaagcaagggccaagaatgcaatttattttcagtatttgaagatgtaaagtcctgtctgctaagttagaaagtcaattgaataccaaatgaagtttatttcttacgtaatagaacaaacatttctttttgcttcgcctaacaatgatattaggaaacataggctttgaagaaagaagaaacaaagactacattctaagtattgcttctagttttgtttcatgcactagggtatacttaactggccttgacataaccaaaaatcaaagcagtggctacaacttagactgagaaaatgcttctgttttattaagctgcatggtttcttctcacctttccccctaccaccaccaccaccattagaaaatgtcatactgtgtggtaaagaaatccagttgaggaaaatgtgttgcagtacacagttatccaccttaagactaatgatttcgaagctttgttaactatttcttttcttgaggcaaaggagcttcttgtgtttccattataagaataattgcattcattttcagaatgcttttttaaaaaaaaaaagtgacagcattaccaaaatagccgagtaattaaattttttctgcctgcctttttctcagttatctgagtacctcttcttccataattttaaattttgaaatattatatggaattttgcacagtattttgagaaagaaaaggtaatgtttcatggtaggtttctcaatttgctgtttaaaactgtttcaatagcaatgtcagtctttatcttgtaagatgtcaaatcgggatttattcctccagtatattttaagacctttaaaaaaaaagtatagtgatttgttacaaaatatgtttttaaagattagattttgattaatgatttagttatatacagcattttaatgcttagtaattactgttctagtagcattttgcaatacaagggatgtatttagattattatactttttttggctcagactttttgtgatctaatttataaattgaaacaatgactcaaagaagtgcatacctaacttacgtttgtgccaagccagcctcctctagtttcaatttaataactagtttcaaaatatattttgatagcaagttcctaaaccacagcagaattgcggatcaggaaaaatacaagataacggcattctataaagatagagggcaggttcccatggctatgttgctaagaaactagtgtttttaatcattacactccgtgcagtcatatttaatcaataaaacaggatatattttgaaattcaccatcacagaatatatatatatatacacacaacatatatatacaagtatatgaatttacgtaaatgtgtacaacactagtgtgtctgacttggtgggtttccctgtgaaacatgtcagtatcatgtaagatgaagaatattttaagggcaaatattcaaatatctttcctccaaacacagtattagttaatagtaatgaaatgattcattaaactgaaaattgcaaaggaactcatgagttcctttgtgattgaaacaaagtgattaaaactcttatgacctgaaggctttccaactagcctccaactgtccgcaccagctgtttcatggatataacattagtgtttgtgtatagcctggaacaatacaaggctgtatctgtatcactagcttcttgccttataagcaggatactgcaaggtctggttgatttctctaatgccctagctaatctgcctaattgacatcagtgtcatgttaatgtatgatgcacaagcatttacagatggacaaatgctccacactaaaaaccacctgctgaattttttttccagtaggatgtgaaattttgcacttctaatctgttgaacatttaaagtcaaaactacatgtttcctttaaatggcctctttaaatgatattttatgtttataaattttgttatgaaaaatttaaaaattagttattcctcttaaatttttactttttccttcaaaggacttgggtgccctctgcaggttataaagagataattagtgactatatctattttaaaaccctgtgatttttctctttcatacacatagcctgcttacacccaatttcaaagaaagtgtgagctaatttatttatattaactcttattaatttgccagtggttgaagttggagtttcttttctccactggttttataggtgtgtttagtgtgaagaatgtgataccattgaacttccagactacttagctggggctctttaaatgttggaactatagtaacacacattccctcacagaaaggagattgggaaaatagctattttgaaagttattgcagatgtagggaatagcttgtttcccattatgtttctagaatattacacatttggagtaagccttgctttttcaacatgcatcatgtaaaattacatgaaagaaaataatttgaaaattacacaagatttctctttcttgatcttgttgatgatgattgtgttctagctcaaaaaacagaccttcttagaatttcttattttttaaaaaagtgagtactcaacagataatactttggtactgcccgttgcagacatgggcctactaaactagaaagagcatttgaagagcaaaaggcaaaggttccatcaccatcctgtggaaatacgtgagttgttcatttcagtacacccatagtttctcaacaggtgtagcagatttgtttctaaaggacataggagtgcattttttatatgaaaccagaactggagtggtaatggcacttctgattcaattaacttacttggtgaagctgccagggaaactaaatatgatgagaagaagaggaatgactggatcaaattaatagaaatagatctttttgcaagcaacataatgattctgatcatcaaccttgaaaagtaaattagaacaagcaaattgctgttgaaaaattctttcagcactctgctgttgctactcagctagtcatagctcagccagagggaaggaaaaaatgcactcggttttgcattaacaaaggaaacattattaaagtgaatgtttacattgtgtttattgaagtgttgaaagaatatttgttgcatcttcaagcaacctgctgctctccagactgttacagtgcatgagtgataataaaaatgagtcagtcacttgtacattttagaaaataaataacttttaacatagtatttctcaactatgttacttcaaaatgtttaagtgccaaacttaatgttaccttctctgctaaagatttttgtctctaggaaatatattccattaaaaaaaaaaagaaagaaactcatttatttatttatttgggtataccttccagttacttccagatgctttatgtaactttcctcccagaagctgcaatacataagaaataataagctgaaaataatcaaaaaatgaaaacaattgtgaaattactgaaatgagtatgtaattgagtatgtaatatatgcattggagaaataccggttgattattgtgataacttttgagagctacagttattttgaactacctcgtaaagactacattgagaatgaaaaagccattgaacaatagatgtaccaatttgacctttaaaagttcaatctttattatatgcattgataaatgggaaagttagtaattaaaaatttagaaggaattttagcctttacctttctaaaatgaacaatttaaatcactcttacactttagaaattgaaatatagtatttaacagggattaaaatgttttacttggtctcttagtgttactgaatacaagtttagtattctgtaatcccttatggattggctgatttttgaagaactattttcttagatttaccaacaggacaagttgtcggccttttcccacatttcaacctaaaaatggtatctatcacagttatcaaagattaccccttgctaaaggctcttaagaaactgttagcctgttactttattacttaccatttctataacatgtacatttatagagcatcatatatttattttaagtctagaatcagtaaaaagttatgtgtttgtcaataatcaaaaaatgtttaatctaaaataaagtagatgccacgcttctaattctgcttttgctaaggcaataatcagtagaagtggttagtaatatttgtagcttgttaaccaactggagcaaaaggactttttaatatgaataacagtggtctcgtgccataagtatttctctcatacatattaaaatagcatgttattttatttaatattgaaggcctaaacacaattgaacataaggtatggcttggaatttagaactgctgagcaatatggttgagagggagaccttaatttagtcaataaaaattcataattaatgttaagctttgtgctcatattatatgccactctgggattagacaaaagacaaaaaacagttccatattttgaacgatatattctacctcctgcagtgtattagcattgtagcgtaggagactatttctgtatgttattagtacagaaactgcccaaaaaggtgatggttgaagttccccagccagttaaagggcacaccgtgggggcagcatatctccatgggtctatctctagcaaacagaatcccagaaacttgagcacctgatatagcagaaggaaataaagattatagtaagtatattcatgagagagaattttttttgcctccagatgtttggggtttggatatgtagggtaaatataaatgtctaatgaaagtaattactattatatttgatttgatatttaatttattatactgaaatactaaattaaatacaaaaaaactcctacatactaactatatgtttctcccactgattcccctcctgcctccttcactgattttgaatgtgtgctcaatttgctagtatgagatttacctctgccttatcagtgaagaaaatatgatgtctatatagaattataaggaaaatatatatgtgaagaaatgttaggtaatctaacatttgtatgctaatgtgtcttagatttaccaactatcctaatgtgtagtcaattgataaactaaatttttctttaggatagttcacatccagtagaacttctaccttggaaaacattcttagccttgtttattttgaatgtatgtgtgtgtgtgtgcatgtgtggaaaacaagaaaaatacaagctctagagtagtggcctcacattgatttatattagtgtgccagtctttcccctacctccctaatatttcaaacttcttgtggacaatgacattcattttcatacctttatatttccagtgccaccagaaacacaaaagcagcttagtgttgatttaatgaagtagcaaaatgttaaatacataacaaaacagattgtcctgtcacctaaaacaaattagtgatgtttgagtaattagggttttgcatgtgtatatagaaaggctattttgcaaacagtggttcagtctgtattgggcacaggtgaattctgccctgcgattgccatctttagcacttttcagagaatttgttgccatttatgacactgatcttcagacacactgtgtagtgccttggcttaaactgtcagactggcaacagctgaggctgcccatcataggacacgttccttgcagttatgcttcagtgaactttaaaacatttggcactcgtatcttagaaatgtccttccgaaactcactctacaacagctttgtgggctccctactatttactagagtcaatcctgattttgtttggcataatgagacctgatatgctatgactctccctatcctataaagccacagctttcagcggtccccgtatactaatgaaatggagtcgccagtatccaaaagttccaagtgattatttagaacatttccattaaccataaaggcaaagtggtatagagaaaataatacagtctttgaagtcacacaggcctgatttcaaatcccagctctgtcatttacaaactgggtggtcctggataaattacttaacctctgtggtcttcagtttcctcccaactttgtagggttattgtgagcattgaatgataccaagttataagtgcataggtattcaatcagtgttcattcccttctgtatcaaagacttataatggccttttcatggaattgtctctacctataattatgtgactgtgccttcagattatcaaaattatatgaattgtccatgtgcccttggttttgaatgttcaattctgtattgcaggaatgcctactcagttgcttgaatgggtgtttggagttaataaaatggctgtacaattga

SEQ ID NO: 105024 - DNA, 1815 bp, Homo sapiens
  Payload ID: 610
  Gene Symbol: AP5M1
  Gene Name: adaptor-related protein complex 5, mu 1 subunit
  ENST ID: ENST00000431972
  CDS Start-End: 260-1774
gttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagggattggcaagaagactcagggtacctgtcattcactataagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaattttgcatctgtgactcagccacagaaacagccagcttggaaaactgggacgtacaaaggaaaaccacaagtttctatttctatcactgaaaaggtaaaatccatgcaatatgataaacagggtatagcagatacatggcaagttgttggaacagtgacttgcaagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagttt

SEQ ID NO: 105025 - DNA, 466 bp, Homo sapiens
  Payload ID: 610
  Gene Symbol: AP5M1
  Gene Name: adaptor-related protein complex 5, mu 1 subunit
  ENST ID: ENST00000556377
  CDS Start-End: 1-180
cttcattttaggatcttagattacacacttactggatgttatgcagatcagcattcagttcaagtttttgcatcaggaaaaccaaaaataagtgcacaccggaaactaatttcttctgattattacatctggaattctaaagcccctgctccagtaacatatggatcattattattgtaatagtctcatgtttaaatgggattatataatgataacagtttaaagaaaatcataatcttatatttttaatgtggatgcatataacctaaaccatctagtcatcatctttatactctacctgcttctgcaattatatatcatattatgttttcagagcagttcattgtcaagttggactttaagtgaccattcaagaaaagatgaaatctcacgaacctcaaaacttcattcatgtctttttacaaatgagaaaaaaaaatgcattaaagattaatactcaatttga

SEQ ID NO: 105026 - DNA, 817 bp, Homo sapiens
  Payload ID: 610
  Gene Symbol: AP5M1
  Gene Name: adaptor-related protein complex 5, mu 1 subunit
  ENST ID: ENST00000555448
  CDS Start-End: 290-406
aagtagaatttagaggaagaaaataccggagttgcagggtataggtaaatttctcaaggttataggttggggttcttagaactttttgtggtgtgtgttggcctagagcgactcagaagcgttagtgacttcacctaaaaaagctaacctctctgctgagcgcgaccggtatgcggcgcaggatgagcctcagggcttctgttaagagtctgtctgagaaagccggtctgcgctgttcctcggtggcgaccttaattatgagatgagctaatgctttactgacttaaccatggcgcagcgggcagtgtggctcataagccacgaaccgggaactccactttgtggcaccgtgagattctccagtgtgatttggaaggaatcatgccaaatgttaccatcagcttgagtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtccctgtcccaccaattttgggtttttatcaaatgaaggaggaagaagtacaactaagaataaccattaatttaaaacttcatgaaagtgtgaaaaataattttgaattctgtgaagcccatatacctttttacaatagaggtccaattacacatttggaatacaaaactagttttggccagcttgaagtatttcgagagaaaagcttattgatctggattattg

SEQ ID NO: 105027 - DNA, 610 bp, Homo sapiens
  Payload ID: 610
  Gene Symbol: AP5M1
  Gene Name: adaptor-related protein complex 5, mu 1 subunit
  ENST ID: ENST00000556995
  CDS Start-End: 366-610
gaataaaacgagcggcgaaagaaccgaaaaaaggctcgacgctaccgtgtatgaggaactttgatccttgcgggccaccattccggaagtagaatttagaggaagaaaataccggagttgcagggtatagacggtatccaactgttgaaaaacgagccagagtcttcaatggagcaagttatgtgcctgttcctgaagatggtccctttcttaaagcactgctctttgaacttagattattggatgatgataaagacttcgttgagagtcgtgatagctgttcacgcatcaataaaacatccatttatggactcctgataggaggtgaagaactctggccagttgttgcttttctgaagaatgacatgatatatgcttgtgttccactagttgaacaaactctgtcccctcgtccgccactaattagtgtcagtggagtttcacaaggctttgaatttctttttgggatacaggattttctttattcaggtcaaaaaaatgactctgagctgaatacaaaattgagccagttgcctgacttgcttctgcaggcttgtccatttggtactttattagatgccaacttacagaattcattagataataccaa

SEQ ID NO: 105028 - DNA, 496 bp, Homo sapiens
  Payload ID: 610
  Gene Symbol: AP5M1
  Gene Name: adaptor-related protein complex 5, mu 1 subunit
  ENST ID: ENST00000554863
  CDS Start-End: 1-280
atttcgagagaaaagcttattgatctggattattggccagaagttcccaaaatcaatggaaattagtctttctggaactgtaacttttggagccaagagccatgagaagcagccatttgacccaatttgtactggagaaacagcatatttaaagcttcattttaggatcttagattacacacttactggatgttatgcagatcagcattcagttcaagtttttgcatcaggaaaaccaaaaataagtgcacgtaagttacacagattcaaactaacttaagggaattaaaatggtgtttgcagttattacctaaggtaaaatttgaatgtaacagaacttagagattagagaataatcccaatttataaaattctgggctgattctaccccacataacagtttgtgtactttacactgccctctgccgccttcttgtttataaagtggtctggataagcaaagattgggatagaggggaacttcagtgtaaaattg

SEQ ID NO: 105029 - DNA, 1960 bp, Homo sapiens
  Payload ID: 611
  Gene Symbol: AP5S1
  Gene Name: adaptor-related protein complex 5, sigma 1 subunit
  Uniprot ID: Q9NUS5
  ENST ID: ENST00000246041
  CDS Start-End: 348-950
gtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgacgtaagctgtcttgaccgctaccatttctctagtagaggcgggacgcggcggcgcggagtgatgacgcgctctgctggcggctggagggttgcggagcacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgattttaccctc

SEQ ID NO: 105030 - DNA, 1791 bp, Homo sapiens
  Payload ID: 611
  Gene Symbol: AP5S1
  Gene Name: adaptor-related protein complex 5, sigma 1 subunit
  Uniprot ID: Q9NUS5
  ENST ID: ENST00000379567
  CDS Start-End: 184-786
ccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggacacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgatttta

SEQ ID NO: 105031 - DNA, 1848 bp, Homo sapiens
  Payload ID: 611
  Gene Symbol: AP5S1
  Gene Name: adaptor-related protein complex 5, sigma 1 subunit
  ENST ID: ENST00000379573
  CDS Start-End: 245-424
ggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgatttta

SEQ ID NO: 105032 - DNA, 584 bp, Homo sapiens
  Payload ID: 611
  Gene Symbol: AP5S1
  Gene Name: adaptor-related protein complex 5, sigma 1 subunit
  ENST ID: ENST00000455742
  CDS Start-End: 325-584
gcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgacgtaagctgtcttgaccgctaccatttctctagtagaggcgggacgcggcggcgcggagtgatgacgcgctctgctggcggctggagggttgcggagcacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagca

SEQ ID NO: 105033 - DNA, 5362 bp, Homo sapiens
  Payload ID: 611
  Gene Symbol: AP5S1
  Gene Name: adaptor-related protein complex 5, sigma 1 subunit
  Uniprot ID: Q9NUS5
  ENST ID: ENST00000615891
  CDS Start-End: 220-822
attgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgattttaccctctttctgtgagtttgatgcgtgcatcctgctcctatgagtgagtgcctctctggatggccccaaagctgcgtgtctgagctttcgtggtcaaggatccccctaggaggcttcttgggatgcctccatctctcatccccacctcacctctgtctccttagaggcctcctttggatggtggcacacatttctccaccaaagtatatgtcacaggtggcaggtggctgtggcagagccgtctgagaagcagtgcttgggctgagaattggtgcgagtggtttatgtggggtgggcggtgatcccgggaagcaggaaggggacacagtcctcgtgaatgcttgtcaagcctattaggactgtggtagggagctgagtgcctctagggggctgcacacagcagttgcctctgaattacctcacctgagaggtggcggctgtgggtgtttgcctactgcctttagtcagtggttacaggttgatcccagggtgcatacattccctggctctttctgcccctgagaaaaagccttcaggcaatgtggagctgggcctgcctgcaccatgttgagtcccaaagggatatgggtggggtaccaaaagtcggtggttaggaggtcttcaatcagcagcttctagtgaaggtttaaacttactcagttgggggcggggggtgggggaaaaaccacttcagtttacattgattttcatgatcttcctgttaccaaggaaggtgaggctttcttggcagaacgagcctcctaggtgctcagctctcatgcttgccatccatcagttgccctttagcatccaggatggacccaactacacccactttggaggcagcactgatgattagcccttccaagtccatggccaaggccaccagccatgccaggccttctaccaccactgtcaacataattgggatgaggccaccttttccattttatggtgccacaaaccaccttgaccatgaagacctaaagggatgttactctgtgtgtgtggccaagtcccaccagtggaaatgtcccacaggcctctagtagggacaccccttccctatacattctgttctcctggcccacccctcaccccaggctggcggtcctggtggattggctgtgttctcagggaacaggccattttgtcctctatggaaaggctcaagcttactgatctgaattctttctgcctttttttcaaacggaacttaaggaagaggttgagactctgctcccctgggagctgtgggaagttgaggttaggcgtggctggtggcctggttctcatgaggtggggcaaactgatggacaagagaatagtagagactgagaccacaccgtggggctgctgagctccagttcctgtccagctggaccagggttttcttaaccagatgagcttgcccagcacccttcccacacttcacacttctgccccagcctcttgggctgggtttccaccacaatttatgctcaccatatatttatcgagcctcccttgggcctgatgctctgctgggtgcaatgcaggatacagaatgaccccaaagttccaggagagacagagctaaggccaggtgactgcagatgactgcaaagcagcaatggtttgagcatccctgaattgctgctcacaagtgctttaaacacctaaaggaagaaggggcacttcagtgacgaaggccaagtgaaggagccaggatttagaactaaaagtgagatggctatggaagcaaacttgcctccctctccaagcctcttccctttcttctccctgccccaggaaccctggccaaaccacatatccctcagcttcttgagagaactagagactttgagcagctagtagtgttaccagtgtacctccacaaacactcctgggacaacagatgatgacaggagggcagtagagcccagagaagagagcttacctggaaggaggaagaagtcacaggttttgttttgttttgttttaggcggagtttctctttgttgcccaggctggagtgcagtggcgcaatctcggctcattgcaagctccgcctcccagattcacgccattctgtctcagcctcccaagtagctgggactacaggtgcctgccaccacgtccggttaagtttttctatttttagtagagacggggtttcaccgtgttagccaggttggtctacatctcctgaccttgtgatccgcccgccgtggcctctcaaagtaccgggattataggcgtgagccaccacgactgactggcatgaagtcacaggttttaaggcaggaactggcctgcatgtatgtgggtcactgattgggtcacatacactgcatgtatgtgagccctgggatgggattggatcatcttgtctcctttagggcagggtgtttttttctagccctgtggtgctgcgcactgtccagcatccccccagggctcaatgttttcttttctttttcttttttttttttttttgagatggagtctcactctgttgctcaggctggagtgcagtggtgcaatcttggctcactgcaacctctgcctcctgggttcaagcaattctaccgcctcagcctcccaagtagctgggattacaagcatgtgccaccatgcctggctaatttttgtatctttagtagagacagggtttcaccgtgttggccaggctggtctcgaactccttacctcaggtgatccacccatattggcctcccaaagtgctgagattacaggtgtgagccaccatgcctggcctcaatcttttcttttaaacaattattcctatattttattgtaatgcagttaaccgtgtttgtcagattcaatactctgtgacccgttaaccaagtctctgtatgtttattactgcaattcaagtggccgtgaccgttttcttaaatatactttatttgtttagtgcaattttaggttcacagtaaaactgagcagagggtacagagagttctcatttactccctgtccccacacatgcacagcctcccttatcaccaacactgggcaccagagtggtcatttgttacaactgatggaccttcattgacacgtcactatcaccagagtccatagtttacattagggttcactcttggggtggtacattctataggtttggatgtattttcagtgacatgcatctaccattatagtatcatacagaagagtttccctgcccgaacagtcctctgctgcacctgttcattcttccctcccctcaacccctagcaaccattgatccttttactgcttccatagttttgccttttccagaatgttgtgtagttagattcatactgtatatgtagccttttcagattgacttccttcacttagtaatgtacatttaagattccttcaagtcttttcatggctgaatcatgagcttgacagctcattttggaagtactgctgaatagtattccattatgtggatgtacattatctgttcacctactgaaggacatcttggttgcttccaagttttggcaattatgaatacaactgctacaaac

SEQ ID NO: 105034 - DNA, 2901 bp, Homo sapiens
  Payload ID: 612
  Gene Symbol: AP5Z1
  Gene Name: adaptor-related protein complex 5, zeta 1 subunit
  Uniprot ID: O43299
  ENST ID: ENST00000348624
  CDS Start-End: 95-2518
tgacgcggtcccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaataagcgtctgtatgaa

SEQ ID NO: 105035 - DNA, 6591 bp, Homo sapiens
  Payload ID: 613
  Gene Symbol: ASXL1
  Gene Name: additional sex combs like transcriptional regulator 1
  ENST ID: ENST00000306058
  CDS Start-End: 1-4611
atgggggttgtgaattttgtgttcagagcgtcagaggacttgcaggtattagaaaactactcggatgctccaatgacaccaaaacagattctgcaggtcatagaggcagaaggactaaaggaaatgagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgc

SEQ ID NO: 105036 - DNA, 7031 bp, Homo sapiens
  Payload ID: 613
  Gene Symbol: ASXL1
  Gene Name: additional sex combs like transcriptional regulator 1
  Uniprot ID: Q8IXJ9
  ENST ID: ENST00000375687
  CDS Start-End: 425-5050
cggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 105037 - DNA, 812 bp, Homo sapiens
  Payload ID: 613
  Gene Symbol: ASXL1
  Gene Name: additional sex combs like transcriptional regulator 1
  ENST ID: ENST00000375689
  CDS Start-End: 183-428
cagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtatgaacctgctgtaagcttgggagtggtctgttagtctacagcttgtgtctgagatgtgctaattgaatatttgctcagtacctcatcttaactgcctttggctttatgttgcttatccttcatagtatcttgttcattggccttttacatccataggcatcacttctctgatattcgttgtgctcttttaatggattaatggtttgcttggttggttcctctagttagactgtaaactccttgagagcagagtctgtattttattaattacccacagtactaggtacatagttgccttcaataaatatatatttaatgaacgaa

SEQ ID NO: 105038 - DNA, 1068 bp, Homo sapiens
  Payload ID: 613
  Gene Symbol: ASXL1
  Gene Name: additional sex combs like transcriptional regulator 1
  ENST ID: ENST00000542461
  CDS Start-End: 433-690
cacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgaggagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtatgaacctgctgtaagcttgggagtggtctgttagtctacagcttgtgtctgagatgtgctaattgaatatttgctcagtacctcatcttaactgcctttggctttatgttgcttatccttcatagtatcttgttcattggccttttacatccataggcatcacttctctgatattcgttgtgctcttttaatggattaatggtttgcttggttggttcctctagttagactgtaaactccttgagagcagagtctgtattttattaattacccacagtactaggtacatagttgccttcaataaatatatatttaatg

SEQ ID NO: 105039 - DNA, 296 bp, Homo sapiens
  Payload ID: 613
  Gene Symbol: ASXL1
  Gene Name: additional sex combs like transcriptional regulator 1
  ENST ID: ENST00000497249
  CDS Start-End: 1-223
gtgggccgaggccgcgcgcctggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaaggtgtgagccactgcaccaggccccttcatcttaattttaatatatctttgaataaacaccattgtatgaacctgctgta

SEQ ID NO: 105040 - DNA, 1034 bp, Homo sapiens
  Payload ID: 613
  Gene Symbol: ASXL1
  Gene Name: additional sex combs like transcriptional regulator 1
  ENST ID: ENST00000555343
  CDS Start-End: 695-868
aattttctctcttattttgaagtgagttttctgcttcaaaggtgttgtgcaaaaaaaaaaaaaatagactgtattgggggggttgacacaaacctgaagtacacctttttctttctcgaagtctgtaaaagttacagatttataaaaactgaaggaatttgggctacagaattttcattggtgcttgctatcctcttccctagtcatttgttgcccagggaacaaaaatagcaattgtttgtatgctgaagttttgtgcttcagtttattttggcctggcatgtgaagtttgaagattttgaggttccgaaatattttttttctgattgagtcaaaattggaagcttgggctagttttcaggatcttgtagaaatttcaggatttctctaacggttctgcacctggaaacaaatataggcctgatggggagtgggagagagctctcgttctcctcctcgacaatgagttttgtgtgttcattgacattctccttggcgttcctgttatgcgggtgtttatgaccctgggcacccaaggaaatttgcttgccagagttttacttgttagagtctctttagattctcgaatttaccgtggtctgaacttcaacatcgaggttgctatttctgttttatcattgactcaacttcaagccaggttatcagggtattagaaaactactcggatgctccaatgacaccaaaacagattctgcaggtcatagaggcagaaggactaaaggaaatgagaagtgggacttcccctctcgcatgcctcaatgctatgctacattccaattcaagaggaggagaggggttgttttataaactgcctggccgaatcagccttttcacgctcaagagatgaagtcttgctatgttggttaaactggtctcaaactcctggcctcaagtgatcttcccaccacagcttcacaaagcactgggatggattacaggtgtgagccactgcaccaggccccttcatcttaattttaatatatctttgaataaacaccattgtatgaacctgc

SEQ ID NO: 105041 - DNA, 7038 bp, Homo sapiens
  Payload ID: 613
  Gene Symbol: ASXL1
  Gene Name: additional sex combs like transcriptional regulator 1
  Uniprot ID: Q8IXJ9
  ENST ID: ENST00000613218
  CDS Start-End: 433-5058
cacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgaggagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgc

SEQ ID NO: 105042 - DNA, 5374 bp, Homo sapiens
  Payload ID: 613
  Gene Symbol: ASXL1
  Gene Name: additional sex combs like transcriptional regulator 1
  Uniprot ID: Q8IXJ9
  ENST ID: ENST00000620121
  CDS Start-End: 196-4821
cgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgccggggagaaggatgaaggacaaacagaagaagaagaaggagcgcacgtgggccgaggccgcgcgcctggtattagaaaactactcggatgctccaatgacaccaaaacagattctgcaggtcatagaggcagaaggactaaaggaaatgaggagtgggacttcccctctcgcatgcctcaatgctatgctacattccaattcaagaggaggagaggggttgttttataaactgcctggccgaatcagccttttcacgctcaagaaggatgccctgcagtggtctcgccatccagctacagtggagggagaggagccagaggacacggctgatgtggagagctgtgggtctaatgaagccagcactgtgagtggtgaaaacgatgtatctcttgatgaaacatcttcgaacgcatcctgttctacagaatctcagagtcgacctctttccaatcccagggacagctacagagcttcctcacaggcgaacaaacaaaagaaaaagactggggtgatgctgcctcgagttgtcctgactcctctgaaggtaaacggggcccacgtggaatctgcatcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtggggacggatggcctgttgcgtctcagcagcagtgcactaaataacgagttttttacccatgcggctcagagctggcgggagcgcctggctgatggtgaatttactcatgagatgcaagtcaggatacgacaggaaatggagaaggaaaagaaggtggaacaatggaaagaaaagttctttgaagactactatggacagaagctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccggattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattccgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagca

SEQ ID NO: 105043 - DNA, 8889 bp, Homo sapiens
  Payload ID: 614
  Gene Symbol: ASXL2
  Gene Name: additional sex combs like transcriptional regulator 2
  ENST ID: ENST00000336112
  CDS Start-End: 329-4552
gtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagcagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtg

SEQ ID NO: 105044 - DNA, 3299 bp, Homo sapiens
  Payload ID: 614
  Gene Symbol: ASXL2
  Gene Name: additional sex combs like transcriptional regulator 2
  Uniprot ID: Q76L83
  ENST ID: ENST00000404843
  CDS Start-End: 439-3195
tcctccaggatgcattgagttttttcacttaaatcaaagtggctcccgcctgggcaacagatatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttca

SEQ ID NO: 105045 - DNA, 12878 bp, Homo sapiens
  Payload ID: 614
  Gene Symbol: ASXL2
  Gene Name: additional sex combs like transcriptional regulator 2
  Uniprot ID: Q76L83
  ENST ID: ENST00000435504
  CDS Start-End: 295-4602
acagtagtgacggccgcgcgggagcggtcacatgaccgtagcggcagcctgtacagtaagaacccaatatggcagcggcggtagcagtggcaacggcagcaagaggaccggccgccccatagacccccccgcgcaccacccccgccgcttcctctgcttgggtgcccccccggtctgacttcccttttctcccacctttcccggcaccgcgggaaaagcagcgcagggcagagcaggcagggagggcggccggagcccggacacgggagcctcccagtcagttcaagacccgacatgagggaaaagggacgtaggaagaagggcaggacctgggcggaggccgccaagacggtcttagaaaaataccccaatacacccatgagtcataaagaaattcttcaagttatccagagagaaggactaaaagaaatcagaagtgggacttctcctcttgcatgcctgaatgcaatgcttcacacaaactccagaggtgaagagggcatcttctataaggttccaggtagaatgggagtatatactttgaagaaagatgtgccggatggggtgaaagagctgtcagaaggttcagaagaaagcagtgatggtcagtcagattcccagagttctgagaacagcagcagcagcagtgatggtggcagcaacaaggagggaaaaaagagcaggtggaaaaggaaagtatcgtcgtcctccccgcagtcaggctgcccatcacccaccattccagcaggtaaagtcatttctccatcacagaagcacagcaagaaggcactaaagcaggcgctaaagcagcaacagcagaagaagcagcagcagcaatgcaggccaagcatatccatctcctccaaccagcatctctcactaaagactgtcaaagcagccagtgactctgtacctgccaaacctgcaacatgggaaggaaagcaatctgatggacagacaggcagccctcaaaactcaaactccagcttttcttcctcagttaaagtggaaaatactttactaggcttggggaagaagtcattccagagatctgagagactccataccagacaaatgaaaagaactaaatgtgctgacattgacgttgagacaccggactccattctggttaatacaaatctgcgagcactgatcaacaagcacacattttcagtccttcctggagattgccagcaacgactgcttttactactcccagaggtagatcgacaggttggtccagatggtttaatgaagttaaatggctcagcccttaacaatgaattcttcacttcagcagcccaaggctggaaggaaagactctcagaaggtgagtttacacctgagatgcaggtgagaattcgacaagagattgagaaggagaaaaaagtggagccatggaaagaacaattctttgaaagctactatgggcagagttctggcctgagccttgaagattctaagaaattgacagcttctcccagtgatcccaaagtaaagaaaaccccagctgaacaaccaaaatccatgcctgtgtcagaggcctctcttatcagaatagttccagtagtctcccagtcagagtgtaaagaagaagcattgcaaatgtcatcaccaggcagaaaagaagagtgtgaaagccaaggtgaagtgcagccgaacttctccacatcttcagagcccctgctttcctcagctctcaatacacatgagcttagcagcattcttcccatcaagtgcccaaaggatgaggatctcttggagcagaagccagtcacctctgctgaacaggaatctgagaagaaccatctcaccacagcttctaattataacaaaagtgaaagccaagaatctttagttacatcgccaagcaaacccaagagtcctggggttgaaaaaccaatagtgaagcccacagcaggagcgggtccacaggagactaatatgaaagaacctctagcaactcttgttgatcagagcccagaaagcctcaagaggaagtcttccctcacccaagaagaggcccctgtgagctgggagaagaggccacgtgtcactgagaatcgccagcaccagcagccatttcaggtctcaccacagccctttctcaatagaggggacagaatccaggtgcgaaaagtaccacctctcaagatcccggtctccagaatctcccccatgccgtttcatccatcgcaggtctctcccagggctcgttttccagtctccatcactagtcctaacagaacaggagccagaactcttgcagacatcaaagcaaaagcccaactggtcaaagcacagagggcagcagctgccgctgccgccgcagctgctgcagccgcctcagttggagggaccattccaggacctggcccagggggtggacaaggtccaggagagggtggtgaagggcagactgctagaggaggcagtccaggctcagacagagtcagtgaaactggaaagggccccacactggaactggcaggaactggaagcaggggaggtacgagagagcttttaccctgtggtccagagactcagccccagtctgagaccaagaccaccccaagccaggcacagcctcatagtgtctctggagcacaactacagcaaacccccccagtgcctccaacacctgccgtcagtggagcatgcacaagtgtcccatcaccagcccacatagagaaattggataatgaaaaactgaaccccaccagagcaacagccacagtggcctctgtcagccatccacaagggcccagtagttgcagacaggagaaagcaccttctccaacaggtcctgctctaatctcaggtgcctcacctgttcattgtgcagctgatggcacagttgagctcaaagcaggtcctagtaagaatatacctaacccttcagcctcatcaaagacagatgctagtgtgccagtggctgtaactccctcccctttaacatctttattgaccacagccactttagaaaagcttcctgtaccccaggtcagtgcaactacagcacctgctggatcagctccaccctcgagcactttgccagcagcttctagccttaaaaccccaggaacttctttaaacatgaatggacccactttaagaccaacctctagtatccctgctaataatcctttagtgactcagctgcttcaaggcaaagatgttcccatggagcaaattctgcctaaacctctcaccaaagttgaaatgaaaacggttccactgactgcaaaagaggaaagggggatgggagcgctcatagctaccaacacaacagaaaatagcaccagagaggaagttaatgagagacagtcccatccagctacgcagcagcagctgggcaaaaccttgcaaagtaagcagctcccccaggttccaaggccccttcagctcttttcagctaaggagctgagggactccagcattgacacacaccaataccacgaaggactaagtaaagcaacccaagatcagatccttcagactctcattcagagggttcggaggcagaatcttctctcagttgtgccgccctcacagttcaacttcgctcactcaggtttccagctggaagacatctccacaagccagaggttcatgctgggttttgctggcagaaggacatccaaacctgcaatggcagggcactacttactgaatatttctacctacggccggggctcagagagctttaggaggacccattctgtaaaccctgaagatcgtttttgtctaagcagccccactgaagccttgaaaatgggatatacagactgtaaaaatgcaacaggagagagtagcagcagcaaagaagatgacactgatgaggaaagtactggtgatgagcaggaatctgtcacagtgaaagaggagccccaggtttcccagagtgctggcaagggtgacacaagttcaggacctcacagcagggaaactctatctaccagtgattgcttagctagcaagaatgtgaaggctgagataccattgaatgagcaaaccactttaagtaaggagaattacctgttcactagaggccaaacatttgatgaaaagaccctagccagagatttaattcaggcagcacagaagcagatggctcatgcagtgagaggtaaggcaatccgtagcagccccgagcttttcagttctactgttcttcctctgcctgcagacagccccacccaccagcccctactccttccacccctgcaaaccccgaagttgtatggaagccccacccagatagggccaagctatagaggcatgatcaatgtctccacctcatctgacatggaccataactctgctgtaccaggtagccaggtatctagcaatgtaggtgatgtcatgtcattttcagtgactgtcactaccatccctgctagccaagctatgaatcccagcagccatggccagaccattcctgttcaggcgttctccgaagagaacagcatagagggcacgccttcgaaatgttactgccgcttgaaagccatgatcatgtgcaaaggctgtggcgctttctgccatgatgattgcatcggcccctccaaactgtgcgtctcctgccttgtcgttcggtaatgagactagaaagagatacactgtaaaggagggggaagggaagggttgaccagttgggttttttgcgtccttttggaatcacagaaataaacaagtaggtttcagttgtcttcagagacaaatgttacttaatcaggaatacaaagtacagattttttacattttagaggaagagcaccttgtatagtaagtctaagtcaagcaagactttgtgaatttgtgacaagtttgcacttacaaaatcatgtaaatatgtcacattttgtttaacattatttttccaagtgtttaggtaataatgtattactttgaattcagattaatgttctactacttgtgactgagaaaagtttaatgccggcatggtaaaaggaagctgtctcccttctgacatttcctaggaagctaggaaaaggaaagtgaaggaatggtctaaagaaatgaccattcacactgattttgtctggacagtctggccgcaggttattcatagattattcagcctttgcaggacttggattcagggttttactcagtccctttaccttaggtggaatcttcttaaattgaaatttttggtaaggaattcatttcacaggtagtgtttcagactctgaaagccctgacttggttcttggcttctactgtactagttactagttactggtactgttgccaagcaatctgcttggaatttgtggatccctgctgttccctaatcccaccccctgccctgagacagtgaatgtagtccgtgaagggagtgcctctctgggaccccctgtgttgttacaggctgtgcagtgcaacaattccagcaaaaataccctatccccgcacttagtcattcgtggtaactaacaattttgaaatactcatataaaatgaacaggaaagtgttagtgattgggtgatttgagctacatcttgttgagcaaggggagtgaaaccacagaaactgttaaattgaacgtaaataactttggaaaacagttttgacactagaacaaggtcgcttctcttttcctcttctctcccaacctgttaacctagtgctagatagtcagctgctgttgcaggtagaaaagctcaccaatgccacatttgttcattctgttcaacctgttttgacctcccaggcatctgaacaggatgacatcatcttattatatcttactttacacatacgtgtatgtacacacacacacacaatacaagacatttttcctgttttagaaaatatagcccttgtttggattactgctgtctgagcactagaaatttctaatggaaagaggcctctgaatggctaagggaacatctggaaaggaaggaaaatgagccctaaaggttttttggttgcttgtttttgtttctttttctttcttgtttccttttttgtttttaaatccttctctagtgactgaagaaattgtgagtacataatatttaggtcatggttaaggaacattaaaataaacctgcagtttaacagaattttgtattaaatgggggagtgtcaatttgcatcatttgcatattgatttcaagtctcctaatttggaatgggtaaagtacaaatgttaatgcaacatagtacagttgtatttgtccttcatattcaggatgtgatatttacaaaatgcagaacagtttaaacttgttaagtcacattccagattaggagaaaatgggcaataatcatctctgttttgcccccattctactacccaccactgcccaccccacccccacatcacacactcttcgatgctttcccacagcccctgctccgctcctctccgtaagaaactcacttcactgtttttcacttttcacttctggcttttttgtggcccaaggccaatataggattaatatctgtgttccagcttcagccagaacgatatgtctgtccatctttctcctttcttccagcacacacagctaagagataagaaggctgcaaggattggggataaggagtatattttcaagccaagaaccagtagaaaacagaaataatggtgctcccaaatattcagtaccttgggcaatccaggaagggtttaaagagacctgttgctgcatagaactctccctgccctaccccttaactccaccttagtgccagggccgagggctggtctgcatgctggaagaggttgagagttttggaattgattccatgctaaatgtcagttaccagtttggattgatgaaagtgatttttctgctttacctttttcctgtcagaaaggttttcctctgtgctacccttaacttagggatgaacagactataactaggaaaggaggaaaggtatcagggatttttaagtccgtttagagagcaaaccatattgtgcctcttcatcttgacccaggctcttatagataggtcctaaacattgctgttcactagattatcttaacaaataatactcagctaaatatttgcatttaggaatactcctaaaacagatattgccaactagatacactgcctcaatcttgaccagacaagagaacagttaagttctctcagttgggtagtaacttgaataccagtctatttatcagttggtttcaacacagaggtttcaagtggaaagccattcatcttaaaagctgaacagaaaaattaaaaaaaaaaaaaacacattacaatctggccttttagaaaatgaagcagtagaaacaaaacctttattagtatggtattccagcagcacctttaaagcaatctttaccttagttttttgagttgttttacctttcatcccaatctgaaaagttttaataaatgctgagcttattcttagggtatgacctggcattatttccagtgactagtcaggcattatgcctgatgcatacgcctcccgtgcacccctatctagccttcagatgtcctccactgcaggtcaccccaggagatagcatcaataatatagtctcagtcttgtttataaagattctaagttgtctagtaaataagtctccctgaatcttaaataattttggagaattagaattctccatcctattaaacagaaagtaaagccaaatagcctggagttgtttgtcctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagacctcattgccttccaggtgaaggtgcaaagtcatacatattaatgacctgacagttaacattctgttgtttattattgcctttctccaccttagagagccataaataactctctggtgaagtgatttgctataatgggggtgaggagtggggagacttctctggtcattacactgctatttatttctagaactcactatcagtgagcagtgccagagtgttttctctttgacctagaggtttcacatcatagcaaggagggaaaagtctccccatctccttacaactgtgtgctaagtaagtaacttggccaagggtagttttcagctcaatttatagaatagtccaaagagactttgagaaacatggtgataggcaggggcctttcctaccatgtttcaatacctacaaacctattgaaagagaacagtaggtaaaacatttcctaaagttgaagcaatagcttcgtagattcttggttactttattttttttaatgctttacatttgatacaactattgaagatcaattttaaaaatagctttccagtaatatattttaagtaatatatattttaatatctgtaaaaagtgacagtggaagactttgaatttctcatatatggtatgtttgatgtaggacctcactgttaaggcacaaattatttcaaaggaagttactctaaagacactcagattatttcagaaaaatgcaataaggggaatagttttggggtttattttttattttaaaagaaaattgacttatttaccacaagctatttttttcccttctggctgtaaggtttgtacagactggtttggtaaatgctaaacttttgtgtcttttgcctttttaaaggaattgttaacattggaattgagggtatgtacagagaagttggtgtcaacaccatttaaaaagtcatattttttcacaaatatagaaaatcattttacataagaattttaagtatttgcaataaatatatgtatatagattgtatgtattcctatattcttatttttcattttattattaagtaaaagatcattaaaagtgaaaataaaaaccttggagttttttggtgaatcttgaggtttaacatacatctgagagtggcgtgggtaagagtcctcagttactgccttatactcctatgggatggttcccacagattgtatggaagagagtaaaatgaggaacttggtgataaatcagggtagtgtatttcttttggaatttaagtaaaactgattaaattttccttatctgtctgtctccatgttttctcccttaatctgttttgtctcctaaccccctaacattactggaaaagtgaagaaatgcggtgcagcctctttattaatgtgcccattgtttgctcctaaatcaaagaatggtaaggaaatatctcgggggaaaaaataggttttcctttctccacagtggttgacatttactgccaccactttccaggccttaggggagtgtgaagaaatagtttcttgaagatgatagaaatttttttttttccgtttcccagttctctcagaagtgagtttcatagccagtcatgtccttcctgcccgtctaatctggagaggtcaaagagcaaggaaaataatgtgaagagaaacacctgtgccttgattaggttctatttcagcatttgacacttgaattttgaactcctctgggtcaggaagggtagctatggaaatgaggtctgagccagttggtaggagaggttgtctatgttcccataccgagattgctgtctaatccacgagaactcattttgtggctgcaaagtaaatacttgattttaggatatgataggagcaaaatggtgcctacatcgtctttataaagaaaagtatatagcccattttttaacaaatgaataatatatcgaatcattgatgacctaaaagaaaaattgttaaggtcagattttcgagagtgtatcttgatgacccataaaactgactttttattgtagttcactagttcccataattgcccagctgtggttactttcactgaaaagaaaaaatatattttggaagttaatgtaaggatacattggctttttttttttttctttacattggctttttaaaagacagtttttatttttcagatactggaatgtcaagtatctgggttgtcccaagacgttggagataattcagccttccaagagaacagcagtctagatcttagctgaaaatgtgctgtttctaaaggaagcttcttaagtctcaggggacattagcatcttcataatttccatatataataagaatgaaggtaaaatatttaaatgtgtataaactaatccataatgaccatttacaaagattgactccccatttctggtacatatttatcattatttagatgggtctcctatcttgtgggaagataaatttatattcaggtgatgacatgggtgcctgcaagtagagttggtctgcagctgagggagaaggcaacataccagaagacaaggcagcttcaacctggatccccagctaccctttatttacttcactgagtcagaaacccgtgttcattgcttctgagactacttgacctcagctggtctttagaagtctggtaactttttatgtacaaatcatgttatttactaattcaagtatttatagagcacctactgtgcactaagcactaaagtgctggttatgcaaaggtaagcaaaaatagtcatgtaagttgcagaaaggttttcctaaagtagtgactatacagcatgtttttagttctaggctcaaggagtaatactacctttttcccaagataggttgaaaatttaaatgagttatgaaatggaagtgtttgagacactggacacagtagtggcaaatacatgaagaaagaaggtccctagatgaaaaaagtgtggaaatgaggagccatattaataaaatgcaccttttttgagaactattgttggaatagctaaagttgtctatagaaatttcaagaaatctcttaacatctaaattagaagcaggccaacagcaatctctgtcagtagttaatttaggtcagtaagttagtgttttgttaaactaaccctttcaaacacagttgggtaaataatgcagctttcctgtcactgttcaaacctaaaagaagctaaagggaatttttcttaaaacatgattttcatcttatagatgataagtaactgtatctcttcatttggaattgttgcatcccagtttttctccataatggataaaattacttttgtgtccttttctattctaatgtagaagtggcttttccttttttctcttgagtcacaacttgaattaaaaagggcttcagcaggactctagcgctttttaaagaagaatttggtgtattccactatgtaacgtagtctctgtccaggaaccaggaggatgagtgtcctcagttttcctaatacttggtaacatttaataatagattgagttttgcttttgtttttcatagagactgtatagactctgtacttccatgtaactttctgccttaacctaaaaaggcattccctggaaggagatcttgtaacaggaagaaaaagcgaaaccaggaaaagagccagaaaggatcaacttggagatgggctgtggctaaatagtgggttttcctgaaaagtaactgcaaccttgcttttcgtgcttcttcaaacccaaaagaacctaaagggaatttttaaaaatcctgattttcttcttaattgtaaaacctagaggatgccttagggagaagaaagataacctggaatttggttttaaatggatttaagtaaactttgaattaagtagcttattccatttttgagagatttctttttaagattttagattcacttaatgtaatgttgaattgccatgaatgtaacctggagtttgatttgagacattctgtgggataaggaatagttttctattgaactgtggtggcttttgccactaatcaggatttagggctgtgcacctccatctgttaagtgaaatggaacttggcttcctaaacactatattagaccaacttgagtcaatacttttattaagtttaatcagggattctcaaaatatttaggattcaaattagcccaattagaaagcagtgcattaaatgttaccaaaatatctgaagatactttagaactattttacacaaagcttatgtctttcctatggaaagtatcatacataaaattttacattcttttaaaaaacagaatctaatgtcttcagatacctagagcttggaaattataatagagttgggctttgacccgaagtcagcagttcttttcattttagattttcaggcaagtttcagtagtttggagacttcttcagtagtgaccccagcttaacctacatataatcactttgcacacattttaagttaatcagatgcttccagagtcttggatttggttacccctttgttagataaggagacagattctaggttgggacaaacatcttaatttattctctaataataaagtactgattaaagagcaagttctcagagaattcacaaaatttctagaatccatgaaagatctagagaacataacaaatgaaactctagaaatttgaaagaaaaaaaaacacttagctgtaagtgctttgacctattttttttaaaaaaaaaaaacctgtcttaattctgtgactgcattgcacccttcaccagcactaagagaagtcggaatggaagaaattaccgtatgtaattcttattcacttaaaatctttgtgcgcataggccttagcactttgacaaataaactctgccttttagctcctcactattgtcttctttcctgtcacttttaggctgtttcattggtcgtataaaaacaaccttcttcgaagttgaatgtatgtttctgcacatagacaaaccatattttactgactcattctatgttgaataaaggcatacagttttacccta

SEQ ID NO: 105046 - DNA, 11344 bp, Homo sapiens
  Payload ID: 615
  Gene Symbol: ASXL3
  Gene Name: additional sex combs like transcriptional regulator 3
  Uniprot ID: Q9C0F0
  ENST ID: ENST00000269197
  CDS Start-End: 1-6747
atgaaagacaagaggaagaagaaggaccgcacctgggccgaggctgcccgcctggcactagaaaaacaccccaactcaccaatgacagcaaagcagatattggaagtcattcagaaagaagggttaaaagaaacaagtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttgttttgacaccattaaaggtgtctgatgagcagtcggattcgccttcaggatctgaatctaaaaatggtgaagcagacagttcagataaagaaatgaaacatgggcaaaaatctcccactggaaaacaaacaagtcagcacttaaaacgattaaaaaagtctggtttagggcacttgaaatggaccaaagctgaggacattgacatagaaaccccaggatctattcttgtcaacactaacttgagggcattaataaataaacatacgtttgcttccttacctcagcattttcaacaatacctcctgcttttgctcccagaagtggataggcagatgggaagtgatggaattttacgcctcagtacttcagctctaaataatgaattctttgcatatgcagcacaagggtggaaacagcgactggcagaaggagagtttaccccagaaatgcagttgcggataaggcaagaaattgagaaggaaaagaaaacagaaccttggaaagaaaaattctttgagaggttttatggagaaaagctgggcatgtcaagagaggaatctgtgaagctcactactggaccaaacaacgctggagctcaaagtagttcttcatgtgggacttctggccttccagtttctgcacagacagccttggcagaacaacagccaaaaagcatgaaaagcccagcttctccagagcctggtttctgtgctactctttgccctatggtagaaattccacctaaagatataatggcagaattggagtcagaggatatcttgatccctgaagaatctgtaattcaggaggaaattgcagaagaggtagagactagtatctgtgaatgccaggatgaaaatcataagacaatacctgaattttctgaggaggctgaaagtctaaccaattctcatgaagaaccccaaatagcacctcctgaagataacttggaatcctgtgttatgatgaatgatgttttagaaactttgcctcatattgaagttaagatagaagggaagtcagaatcaccccaggaagaaatgacagttgttatcgatcagttagaagtctgtgactctcttattccttccacttcatctatgactcatgtcagtgacacagaacataaggagtcagaaactgcagtagagaccagtacccccaaaataaaaacagggtcatcttctctagaaggccagtttccaaatgaaggaattgctatagatatggagctacagagtgaccctgaagaacagctttcagaaaatgcctgcatctctgaaacgtccttttcttctgagagcccagagggagcctgtaccagcctgccttctccaggaggggaaacacagtccacatcagaagaatcatgtactccagcctcccttgagacaacattttgttctgaggtatctagcactgaaaatacagacaaatacaaccagagaaattccactgatgaaaactttcatgcatctttgatgtcagaaatatctccaatatccacttcacctgaaatatcagaagcatctcttatgtccaacttaccattaacatctgaagcatcaccagtatccaacttacctttaacatcagaaacctcaccgatgtctgacttacctttaacatcagaaacttcttcagtgtcttccatgcttctcacctctgagaccacttttgtatccagtttgccacttccttcagaaacatctccaatttccaactcttccataaatgagagaatggcacatcagcaaagaaagtcaccttctgtatctgaagagccactctccccgcagaaagatgagtcttccgccactgccaaacctctgggagagaaccttacctcccagcagaagaatctgtctaatactcccgaacccatcataatgagttcttcttccattgctcctgaagcatttccgtctgaagatttgcacaataagaccctgagtcagcaaacctgtaaatcacatgttgacactgagaagccctaccctgcttcaattccagaacttgcttctactgaaatgataaaagttaaaaatcatagcgtcctgcaaagaacagaaaaaaaagtgttaccttcaccattggaattatctgtcttttctgaagggacagataataagggaaatgagcttccatctgctaaattacaggacaagcaatatatctcatcagtggataaggctccattttcagaaggctctagaaataaaacacataagcaagggagtacacagagtcggttagaaacctcacatacttccaagtcatcagagccctccaagtcacctgatgggataagaaatgaaagtagagattcagagatatcaaagagaaaaactgcagagcaacacagctttggaatctgtaaggaaaagagagctaggatagaagatgatcagtcaacccggaacatatcatctagcagcccacctgagaaagaacagcctcccagagaggaaccaagggttccccctctcaagattcagctttccaaaattgggccaccttttataatcaagagccaaccagtctccaaacctgagtctcgagcatccactagcacatctgtcagtggcgggaggaacacaggagccaggaccctcgcagatatcaaggcccgggcccaacaagctcgggcccagcgagaggctgctgcagctgctgctgtggctgctgcagcgagcattgtctctggagccatgggaagtccaggagagggtggaaagacgagaactctggcacacatcaaagagcagacaaaggctaagctctttgcaaagcatcaagctcgagcccatctcttccagacctctaaagagacccggttgcctcctccgctcagctcaaaggaagggcctccaaacttagaagtctcttctacccctgaaacaaaaatggaaggttcgactggtgtcattattgtcaatccaaactgtagatctcctagcaacaagtctgcccacctccgggagaccaccactgtactacagcagtctcttaacccaagtaaacttccagaaactgccactgacttatctgtgcatagttctgatgaaaacatacctgtgtcacatttatctgagaaaattgtttcatctacctcttctgaaaatagcagtgtgcccatgctttttaataaaaattctgtccctgtatctgtttgcagcactgctatatcgggagcaattaaagaacatccctttgtgagttctgttgataaatcctctgtcctaatgtctgttgacagtgcaaacactacaatttctgcttgtaatataagcatgttaaaaaccatccagggaactgacactccatgcatagccattataccaaaatgtattgaaagcactcccatttcagccactacagagggctccagcatatcaagctccatggatgataagcagttactaatatcaagcagcagtgctagtaacttagtctccactcagtacacctctgtgccaactccctccatcggaaacaatttgccaaacctctccactagctctgtcttgattcccccaatgggaattaacaacagatttccttctgagaagatagccatacctgggagtgaagaacaggccactgtatccatgggtaccactgtgagagcagccctcagctgcagtgattctgtagcggtcacagactctctggttgcacacccgaccgtcgcaatgtttactggaaacatgctgacaataaactcttatgatagtcctcccaagttaagtgctgaaagcttggacaaaaattcagggcctcgaaacagggcagataattctggaaaacctcagcaaccaccagggggctttgcaccagcagccataaaccgatcaattccgtgtaaagtcatcgttgaccacagcaccacgctgacctccagtttgtctctgactgtctccgttgaaagctcagaagccagcttggacctgcagggcagaccagtgaggacagaggcatccgtacagcccgtggcgtgtcctcaggtgtctgtgattagcaggcctgagccagttgccaacgaaggtatagatcacagttccactttcattgctgcttcggcagcaaaacaagacagtaaaacattgccggccacctgcacaagtctccgagaattaccccttgttccagataaattaaatgagccgactgctcccagtcataactttgctgagcaggcacgtggcccagctcctttcaaaagtgaagcagacacaacctgtagcaatcagtataacccaagtaaccggatttgctggaatgatgatgggatgaggagcacaggacagcctctggttactcactcgggttcaagtaaacaaaaagaatatctagagcaaagctgtccaaaggctatcaaaactgaacatgccaactacttgaacgtgtcagaacttcatcccaggaatcttgtaacaaatgttgctcttcctgtgaaatctgaacttcacgaagcagacaagggctttagaatggacactgaagacttccctggccctgagctgcctcctccggctgcagagggagcctctagtgtacaacaaacacagaacatgaaagcttccacctcaagtcccatggaagaggctatttccttggctaccgatgccctgaagagagtccctggtgcagggagctcaggctgtcgtctgtcctctgtggaggctaacaatccgctggtgacgcagttactacagggcaacctgcctttggaaaaagtgttgccacagcccagattgggagccaagcttgaaatcaacaggcttccattgcctcttcaaactacctcagtgggtaaaacagcaccagagagaaacgttgaaattccgcccagctctccaaatccagatggtaagggctacttggcagggactctggcaccactccaaatgagaaagcgagaaaaccaccccaaaaagagagtagctaggactgtaggagaacacactcaagttaaatgtgaaccaggaaaattgttggtggagccagatgttaaaggggtgccttgtgtcatcagttccggcatcagtcagctaggacacagccagccatttaagcaagaatggctaaacaagcactccatgcagaacagaattgttcacagccctgaggtcaaacagcaaaagcggctgctcccctcgtgtagcttccagcagaacctatttcatgttgacaagaatggcggcttccacactgacgctggtacctcacacagacagcagttttaccaaatgcctgtggctgccaggggccccattcctactgcagctctgttacaggcctcttccaagaccccagtggggtgtaatgcatttgccttcaacaggcatcttgaacagaagggattgggagaggttagtctttcctcagcacctcaccagctaaggttagccaacatgttatcccccaatatgcccatgaaagaaggtgatgaggtgggaggcactgcacacacaatgccaaacaaagcactagtacatccgccgccgccaccgcctccccctccccctccacccttggctttgcccccgcctccccccccaccacctccgctacctccacctctccctaatgcagaagtcccatctgatcaaaaacaacctccagttaccatggaaaccactaagagacttagttggccacagtccacgggcatatgtagcaatataaaatcggaacctctttcttttgaggaaggtttaagcagcagctgtgaactgggcatgaaacaagtttcctatgaccagaatgaaatgaaagaacagttaaaagcattcgcgctaaaaagtgcagatttctcttcctatttgctttctgagccacaaaagccttttacccaattagctgctcagaaaatgcaggtgcagcaacaacagcagctctgtggaaattatccaacaatacactttggtagcacgagtttcaaaagggcagcatctgcaattgaaaagtccattgggattttgggaagtggctccaatcctgccacaggcttgtctggtcagaacgctcagatgcccgttcagaactttgccgacagcagcaatgcagatgaattggaactgaaatgctcttgccggctgaaagccatgattgtgtgcaaaggctgtggggccttctgccatgacgactgcataggtccttcaaaactttgtgtagcatgcctggttgtacgataagagctgagtgaaagatgcagtatcccttttccacacggaaaagccaaatagcatcagcaacaacaaatagaataatgcagtggtttctatcatgctaatttattttgctttggagcaggtacctttcctctatggcattattttcttgcatttctcataaaggggaggatgcatcccaactgaatggctcactggcatgtcttttatgtgttcagttgccattcctagctttggaaagtttctatctgtccatgtgtatacaagtcaatgccccatttttgtttttcttttaaccgaggtgtagataggaaaaggacatttttaattacttaataaccggaaatgcagatgtgtaaggagaatgagaggaatgagttaaagtggttatgcatttttctatagatgagccattacagcaaggaattttacagttgacttctctgaacctagctttaccacagtgattaaatcctatttagaaaggggaatctgatttaaatgtgtgattccttgtatttgctcctatcacaaaagatatattaaaggaggtatgccattaatgaaatccactgtcctgagtattatctttcctcctgttgtactttctcagagactatggcagaatatctggatcttccttggattttgtacacatattgtagtgaaatgtgtcctacatctgaaattgcatgggactcatgcccagcaatctggttctaggcctttgacacctgataatatgagagcaattggccagccaatagccataagcccagaggattttagagcttcatgtgtggcttttaagagcaggtttgaaaaaaaaaaaaaaaagaccctaaacttcaaagcaaggaaataagatgctgtatatgcacacataaatgcattgataatgtaaatatcctattcacgctaatgaattactagatattaaaagtggggggtggaaatcattgtagccctttattgatgacacccattcattctggcttcagaccttgcagaggttggccatatctttttaaaagtgtcattgatgataaaagggactacccaaggctaaagcgtcaacatttttcagaacaattgcttttctcattatttacaacctatataattcaactttgaaataacccttattttgaaaaaaactgttctaggtatggcatgttttgttttttccctcaggtatattcaatacattcttcatatttgggggaactgcttttgaaaaagggatactgcatcttaacagttatcttcagtgtgcatccagtaaagtctgcgtgttgagtatttgagctacattccatatattttggccaccctcataccagaggacagccgtagttcaggaggctctgttttcaaaagcaagttcaaaagcacatgcacattgagggaagatgaaagaaaacaaaaaccaaccatgcccatttaacttcagattacagagcacaaaatgtggagtgccattaacccattgattgattgtggctgtagaatttaaaaagcaaacatggggggggtggggaatcatctgtatccagggtaagaatgaccaatattttcacatgggatcatcctaatcactgtaaactttttgacattcccgtaaaacacgtcttaaaagttgactggaatgagcagaaattacattcctgaaaacaagaacacttgtgatttttttataataaccaactatataatatgtttttttctccgtatttattgtgatgttgccaaatttctttctttaggtgatagagacatcatttcgaataacaaattgctgatagtgagaggtactttactttatcttagaaagaaagaaaaggcctgctgctgtagccatgattttggtgcttcagtactgtcatttctgtttttcacagtaaaattggcaaaactaatgactgagaaagttagttagcaatgcacttaaccagccttacccgaggaaagcagcataagttccagtggatccttagttttctcttcactgcctgccaggttgtgttggggtggcatccttatcagtggtgtctttgtctgcctggctctgatatcatcctgatttcgaagatcatgctgttagtctcacagcggggcacccctataatatagacacttgcatgccaactccttccaaattcattcactgctataccagtgtcagatactgtctacaccagcaaattgaaaaccatcacatcagtaactgacatggtgtcggaagaaactccagtctacagaacctttgcactcagtatgtgaggtacaattgaggctgatgagatactgagctcattatcagttccttcattgttgaatactgcctgcaagttgcttattgggaataagaaaaagtgtccttctgtatgttttgatttttcacataacaggcttggagaatcagttgttgatagtgcatggattctatcatccaggtccgattagcataatttttctgcgccctttttttttttttttttgctccagttcaaattcctagtgttctcatatggtttatattactgaaaaattaatatctttaagctaaaatataagggaaaggaagaagagaaatttagatgtaaaatgtgggtcagatattttataggtttccatttaatatatatatacacacaaaatccagtatattctgagtaggttcttagttttctgatttctacatgtgtctgctatgtgcaaatgtagtatattatttactacatggttattgtggtgtagtgtgcaaatgttagcatgtgcattatcctgattactggacacagttttattcttatcaggaatagaacttgcacatgtaccatacaatttttttttttttaatcacaaaggatgtatttccctaagtagcacttttggagcaggggaaggaagaaaactgctattccctaatcctcctcctataagatatgcatatgcctgaggtgtataaagacatttaggttagttaatgggcatgttaataagagcattgtgatgcaaattcattttcaaaatgaaaataattttttcttccccaaaatgagaatagtagaaattttggtgaactgagcaccatagttatataatatttccctgcgaaggtctagtttgaagaaaaaaaaaacttgaaaacaaacctatgaggttgagcctggttgctataaagactttgggatggtatgtgtttctgggatgagctatatagaaagtttagttgactgctggaccttggatattcttactcggttcaaaatacacaaaaacaagctggtacatatggtgctttataatgcagtcgagagtaagaatacatgttgctgtagccccatttcctttacaaacccccgcacaatttcaaaagtggaagttaccgtggcctctggtttcccagttcctccgtggtgtaatgaagtcccaggttttagaagctgaagccaagcctagggtagcatcgtctgtacggtggtgaggcccagcacagcggtagctgcctagtgggaatgaccccctgagcatgcagagcccagagtcactgtccatctgcgttcccagagaacaattgtgaagagtcctagaacaggaactctgaatcagactgtcaggggcctatgtagccaaaatgttactaaatataaaattcctgtcgtcttcagtcttcatgctttgtcactgtaaaaagaacaaaaagcatttttactataatttaaaggagctgcttttttatagcacatactatttcgctttgtactatatttgatagttgcagaataatttagactgtagaaaaactttgttgtatttgtactgttcttgaatgtttcaaagaaagtgctttacttggttgccataattttcttgtactgctgtattcccctccttcccctgcttcatggaaacctgatatgatacatattttcagtagttttttttttttaatgtgtgttcgtttgtacaattttttttttttggtcagtattctgaatgtttacatctgtttgacattagccatttaatgccttttttaaaggcggtattactcctacagtgtaacagcaaaatgtgaaatcaacccaaacataacatgcatgacaaacacagattgggggcgaaggccctgaacctacatagacattttatatcagcatacagaaaagtaaaatcctccttcagtcctctaccaaagaatatattattcccacaggaaaaactcagaaaaggtgtgtaaaatcctcagaagggggagcagttgattcagtaagactgcgacaatttaatactgttacgcttgctttgatacctgactaaatgtgactgagtgcaacaagcatttaagaaaatttttagacagtgttttgtttagaattcagggatcatgcattctttaatggtgctgtttgttttttatttcttttctacaaagaaaacaagtgttgcctacaaaagtgactgctcacaataccataagttaaatgaaatgaaatgtttgtctcttcatgtttctctgtctttccctttctcaaagtaacaacttgggtttcaatattaagatattctggagaaaataaagaaattaaacatg

SEQ ID NO: 105047 - DNA, 540 bp, Homo sapiens
  Payload ID: 615
  Gene Symbol: ASXL3
  Gene Name: additional sex combs like transcriptional regulator 3
  ENST ID: ENST00000590973
  CDS Start-End: 15-191
accccaactcaccaatgacagcaaagcagatattggaagtcattcagaaagaagggttaaaagaaacaagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggaaatggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagcc

SEQ ID NO: 105048 - DNA, 3811 bp, Homo sapiens
  Payload ID: 615
  Gene Symbol: ASXL3
  Gene Name: additional sex combs like transcriptional regulator 3
  ENST ID: ENST00000592288
  CDS Start-End: 18-974
atcaatgagatgcaaacatgaaagacaagaggaagaagaaggaccgcacctgggccgaggctgcccgcctggcactagaaaaacaccccaactcaccaatgacagcaaagcagatattggaagtcattcagaaagaagggttaaaagaaacaagaaatggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttgttttgacaccattaaaggtgtctgatgagcagtcggattcgccttcaggatctgaatctaaaaatggtgaagcagacagttcagataaagaaatgaaacatgggcaaaaatctcccactggaaaacaaacaagtcagcacttaaaacgattaaaaaagtctggtttagggcacttgaaatggaccaaagctgaggacattgacatagaaaccccaggatctattcttgtcaacactaacttgagggcattaataaataaacatacgtttgcttccttacctcagcattttcaacaatacctcctgcttttgctcccagaagtggataggcagtccaggaatgaaccctttcttcaagaagccatggttcccattagtggaggatgtcatgaaatcaagatgtcatgaaagatgggaagtgatggaattttacgcctcagtacttcagctctaaataatgaattctttgcatatgcagcacaagggtggaaacagcgactggcagaaggagagtttaccccagaaatgcagttgcggataaggcaagaaattgagaaggaaaagaaaacagaaccttggaaagaaaaattctttgagaggttttatggagaaaagctgggcatgtcaagagaggaatctgtgaagctcactactggaccaaacaacgctggagctcaaagtagttcttcatgtgggacttctggccttccagtttctgcacagacagccttggcagaacaacagccaaaaagcatgaaaagcccagcttctccagagcctggtttctgtgctactctttgccctatggtagaaattccacctaaagatataatggcagaattggagtcagaggatatcttgatccctgaagaatctgtaattcaggaggaaattgcagaagaggtagagactagtatctgtgaatgccaggatgaaaatcataagacaatacctgaattttctgaggaggctgaaagtctaaccaattctcatgaagaaccccaaatagcacctcctgaagataacttggaatcctgtgttatgatgaatgatgttttagaaactttgcctcatattgaagttaagatagaagggaagtcagaatcaccccaggaagaaatgacagttgttatcgatcagttagaagtctgtgactctcttattccttccacttcatctatgactcatgtcagtgacacagaacataaggagtcagaaactgcagtagagaccagtacccccaaaataaaaacagggtcatcttctctagaaggccagtttccaaatgaaggaattgctatagatatggagctacagagtgaccctgaagaacagctttcagaaaatgcctgcatctctgaaacgtccttttcttctgagagcccagagggagcctgtaccagcctgccttctccaggaggggaaacacagtccacatcagaagaatcatgtactccagcctcccttgagacaacattttgttctgaggtatctagcactgaaaatacagacaaatacaaccagagaaattccactgatgaaaactttcatgcatctttgatgtcagaaatatctccaatatccacttcacctgaaatatcagaagcatctcttatgtccaacttaccattaacatctgaagcatcaccagtatccaacttacctttaacatcagaaacctcaccgatgtctgacttacctttaacatcagaaacttcttcagtgtcttccatgcttctcacctctgagaccacttttgtatccagtttgccacttccttcagaaacatctccaatttccaactcttccataaatgagagaatggcacatcagcaaagaaagtcaccttctgtatctgaagagccactctccccgcagaaagatgagtcttccgccactgccaaacctctgggagagaaccttacctcccagcagaagaatctgtctaatactcccgaacccatcataatgagttcttcttccattgctcctgaagcatttccgtctgaagatttgcacaataagaccctgagtcagcaaacctgtaaatcacatgttgacactgagaagccctaccctgcttcaattccagaacttgcttctactgaaatgataaaagttaaaaatcatagcgtcctgcaaagaacagaaaaaaaagtgttaccttcaccattggaattatctgtcttttctgaagggacagataataagggaaatgagcttccatctgctaaattacaggacaagcaatatatctcatcagtggataaggctccattttcagaaggctctagaaataaaacacataagcaagggagtacacagagtcggttagaaacctcacatacttccaagtcatcagagccctccaagtcacctgatgggataagaaatgaaagtagagattcagagatatcaaagagaaaaactgcagagcaacacagctttggaatctgtaaggaaaagagagctaggatagaagatgatcagtcaacccggaacatatcatctagcagcccacctgagaaagaacagcctcccagagaggaaccaagggttccccctctcaagattcagctttccaaaattgggccaccttttataatcaagagccaaccagtctccaaacctgagtctcgagcatccactagcacatctgtcagtggcgggaggaacacaggagccaggaccctcgcagatatcaaggcccgggcccaacaagctcgggcccagcgagaggctgctgcagctgctgctgtggctgctgcagcgagcattgtctctggagccatgggaagtccaggagagggtggaaagacgagaactctggcacacatcaaagagcagacaaaggctaagctctttgcaaagcatcaagctcgagcccatctcttccagacctctaaagagacccggttgcctcctccgctcagctcaaaggaagggcctccaaacttagaagtctcttctacccctgaaacaaaaatggaaggttcgactggtgtcattattgtcaatccaaactgtagatctcctagcaacaagtctgcccacctccgggagaccaccactgtactacagcagtctcttaacccaagtaaacttccagaaactgccactgacttatctgtgcatagttctgatgaaaacatacctgtgtcacatttatctgagaaaattgtttcatctacctcttctgaaaatagcagtgtgcccatgctttttaataaaaattctgtccctgt

SEQ ID NO: 105049 - DNA, 523 bp, Homo sapiens
  Payload ID: 615
  Gene Symbol: ASXL3
  Gene Name: additional sex combs like transcriptional regulator 3
  ENST ID: ENST00000586596
  CDS Start-End: 1-523
gggccgaggctgcccgcctggcactagaaaaacaccccaactcaccaatgacagcaaagcagatattggaagtcattcagaaagaagggttaaaagaaacaagaaatggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttgttttgac

SEQ ID NO: 105050 - DNA, 573 bp, Homo sapiens
  Payload ID: 615
  Gene Symbol: ASXL3
  Gene Name: additional sex combs like transcriptional regulator 3
  ENST ID: ENST00000588741
  CDS Start-End: 88-192
gagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagtctggtttcagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggaaatggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggag

SEQ ID NO: 105051 - DNA, 594 bp, Homo sapiens
  Payload ID: 615
  Gene Symbol: ASXL3
  Gene Name: additional sex combs like transcriptional regulator 3
  ENST ID: ENST00000593195
  CDS Start-End: 1-186
atgaaagacaagaggaagaagaaggaccgcacctgggccgaggctgcccgcctggcactagaaaaacaccccaactcaccaatgacagcaaagcagatattggaagtcattcagaaagaagggttaaaagaaacaagtctggtttcagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcat

SEQ ID NO: 105052 - DNA, 544 bp, Homo sapiens
  Payload ID: 615
  Gene Symbol: ASXL3
  Gene Name: additional sex combs like transcriptional regulator 3
  ENST ID: ENST00000586327
  CDS Start-End: 101-544
caattgctgggaggagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagttctggaagacagaaagcccagattaaggttggcagtgtccgtttctgtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacag

SEQ ID NO: 105053 - DNA, 752 bp, Homo sapiens
  Payload ID: 615
  Gene Symbol: ASXL3
  Gene Name: additional sex combs like transcriptional regulator 3
  ENST ID: ENST00000592541
  CDS Start-End: 70-246
aggaagaagaaggaccgcacctgggccgaggctgcccgcctggcactagaaaaacaccccaactcaccaatgacagcaaagcagatattggaagtcattcagaaagaagggttaaaagaaacaagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttgttttgacaccattaaaggt

SEQ ID NO: 105054 - DNA, 653 bp, Homo sapiens
  Payload ID: 615
  Gene Symbol: ASXL3
  Gene Name: additional sex combs like transcriptional regulator 3
  ENST ID: ENST00000585426
  CDS Start-End: 93-197
gggaggagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagttctggaagacagaaagcccagattaaggttggcagtgtccgtttctgaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtcatgttcgggaccactctacaagtacagaagatgtgtata

SEQ ID NO: 105055 - DNA, 493 bp, Homo sapiens
  Payload ID: 615
  Gene Symbol: ASXL3
  Gene Name: additional sex combs like transcriptional regulator 3
  ENST ID: ENST00000593235
  CDS Start-End: 61-165
gtactcaggaagagaaacagggaatcctccacagcactagaaaaacaccccaactcaccaatgacagcaaagcagatattggaagtcattcagaaagaagggttaaaagaaacaagtctggtttcagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatgg

SEQ ID NO: 105056 - DNA, 538 bp, Homo sapiens
  Payload ID: 615
  Gene Symbol: ASXL3
  Gene Name: additional sex combs like transcriptional regulator 3
  ENST ID: ENST00000590189
  CDS Start-End: 1-538
aagaggaagaagaaggaccgcacctgggccgaggctgcccgcctggcactagaaaaacaccccaactcaccaatgacagcaaagcagatattggaagtcattcagaaagaagggttaaaagaaacaagtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaatggagtttgttcgaagcaggtaactgatgaagcatcttccactcgagattcaagccttactaacacagcagtgcaaagcaagttagtgtcttccttccagcagcacaccaaaaaggctcttaaacaggctttgaggcagcagcagaaaagaagaaatggagtctcaatgatggtaaacaagactgttcctcgtgttg

SEQ ID NO: 105057 - DNA, 572 bp, Homo sapiens
  Payload ID: 615
  Gene Symbol: ASXL3
  Gene Name: additional sex combs like transcriptional regulator 3
  ENST ID: ENST00000588038
  CDS Start-End: 100-159
aattgctgggaggagctgcccaggtgtgctgaggggcctgtactcaggaagagaaacagggaatcctccacagcactagaaaaacaccccaactcaccaatgacagcaaagcagatattggaagtcattcagaaagaagggttaaaagaaacaagatagaaaataactgacaaggatggaatggggtcaagtagagcaagttaagtggagataagaagacagaattctgttaaccttaaatgcaattatatatgatgagcatttttatagatagcagcttgactcaaaaataatttagggacaaactattttccatttgggatcacctcaacaaccttaacaggcagcaccaggtcttcatatgcttttaagtttaccttctgctatggaaaggatctttccttgaatgttcatattttcatcttgagaagtctggtttcagaccccggcatggcttggagacagcgttggtgtgtatgaaggatcttcctccaatgaaggatttgggacaactttccatgatgattatattagagcctcagctgctttcgtgttggtcatgaggtgatgct

SEQ ID NO: 105058 - DNA, 546 bp, Homo sapiens
  Payload ID: 615
  Gene Symbol: ASXL3
  Gene Name: additional sex combs like transcriptional regulator 3
  ENST ID: ENST00000590225
  CDS Start-End: 79-255
aggtgtgctgaggggcctgtactcaggaagagaaacagggaatcctccacagcactagaaaaacaccccaactcaccaatgacagcaaagcagatattggaagtcattcagaaagaagggttaaaagaaacaagaccccggcatggcttggagacagcgttggtgtgtatgaaggatcttcctccaatgaaggatttgggacaactttccatgatgattatattagagcctcagctgctttcgtgttggtcatgaggtgatgctgaaccgaatgcttgaactagcaggagtggctgggattgcattggagtggttccgttcattccttccggtggaacctctccattagcctgtctgaatgcaatgcttcacactaacactcgaataggggatggaacattcttcaaaatccctggaaagtcaggcctctatgctctcaaaaaagaggagtcgtcatgcccagcagatggcacgttggatttagtctgtgaatctgaattggatggtacagatatggccgaggcaaatgcccatggagaagaaaat

SEQ ID NO: 105059 - DNA, 4045 bp, Homo sapiens
  Payload ID: 616
  Gene Symbol: ADD1
  Gene Name: adducin 1 (alpha)
  Uniprot ID: P35611
  ENST ID: ENST00000264758
  CDS Start-End: 189-2495
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtct

SEQ ID NO: 105060 - DNA, 4743 bp, Homo sapiens
  Payload ID: 616
  Gene Symbol: ADD1
  Gene Name: adducin 1 (alpha)
  Uniprot ID: P35611
  ENST ID: ENST00000355842
  CDS Start-End: 864-2852
gggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtatgcattactggggccttttgagcagctgcttctgcaagaggacatccggagacacaggaatagaaatgatccgatcagagtaattaaaggcttttaactgagctctgaggtcccaaacagggcacactccgtcagcctaaagctgtgaagaagaaccttcaacataaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccaggatgcacctctctctgactgtacggaaactatcgaagggctcgagcttacagagcagacctttagtcccgctaaatctctctcttttagaaagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaa

SEQ ID NO: 105061 - DNA, 2361 bp, Homo sapiens
  Payload ID: 616
  Gene Symbol: ADD1
  Gene Name: adducin 1 (alpha)
  Uniprot ID: P35611
  ENST ID: ENST00000398123
  CDS Start-End: 21-2009
gaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctga

SEQ ID NO: 105062 - DNA, 4079 bp, Homo sapiens
  Payload ID: 616
  Gene Symbol: ADD1
  Gene Name: adducin 1 (alpha)
  Uniprot ID: P35611
  ENST ID: ENST00000398125
  CDS Start-End: 189-2177
gcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtct

SEQ ID NO: 105063 - DNA, 3787 bp, Homo sapiens
  Payload ID: 616
  Gene Symbol: ADD1
  Gene Name: adducin 1 (alpha)
  Uniprot ID: P35611
  ENST ID: ENST00000398129
  CDS Start-End: 21-2234
gaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaa

SEQ ID NO: 105064 - DNA, 3745 bp, Homo sapiens
  Payload ID: 616
  Gene Symbol: ADD1
  Gene Name: adducin 1 (alpha)
  ENST ID: ENST00000446856
  CDS Start-End: 124-1326
gctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtct

SEQ ID NO: 105065 - DNA, 3107 bp, Homo sapiens
  Payload ID: 616
  Gene Symbol: ADD1
  Gene Name: adducin 1 (alpha)
  ENST ID: ENST00000513328
  CDS Start-End: 73-1971
ggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaagtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagcaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggc

SEQ ID NO: 105066 - DNA, 671 bp, Homo sapiens
  Payload ID: 616
  Gene Symbol: ADD1
  Gene Name: adducin 1 (alpha)
  ENST ID: ENST00000511797
  CDS Start-End: 259-671
ggagccggagccggagccgacgggcggtggccgcactgggaccccggaatcccgcgcgctgcccacgattcgcttctgaggggccttttgagcagctgcttctgcaagaggacatccggagacacaggaatagaaatgatccgatcagagtaattaaaggcttttaactgagctctgaggtcccaaacagggcacactccgtcagcctaaagctgtgaagaagaaccttcaacataaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgta

SEQ ID NO: 105067 - DNA, 3206 bp, Homo sapiens
  Payload ID: 616
  Gene Symbol: ADD1
  Gene Name: adducin 1 (alpha)
  ENST ID: ENST00000503455
  CDS Start-End: 59-2050
cccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgccttaaacatgagtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagcaggagacggatgcgctagagagtacctgttaccctaaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccctggctctgccagcgtccccggccacgtctgtgctctgtccttgtgtaatggaatgcaaaaaagccaagccctccgcctagaggtcccctcacgtgaccagccccgtgtagccccgggctgacccagtgtgtgctcagcagccccaccccaccctgccccttgtcctctcagagcctcagcttctgggggagacatgctctccccacaggggggaggcactaagtcatggtcctggctggaaggtactgaaggcttctgcagctttggctgcacgtcaccctcctgagcctcacctttcctgccgtccctcctgttgtgaaatcaccacattctgtctctgcttggcttcccctccaccctaaagtctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttcttt

SEQ ID NO: 105068 - DNA, 1332 bp, Homo sapiens
  Payload ID: 616
  Gene Symbol: ADD1
  Gene Name: adducin 1 (alpha)
  ENST ID: ENST00000514940
  CDS Start-End: 1-1332
aggttcttattctccggaaccatgggctcgtgtcagttggagagagcgttgaggaggccttctattacatccataaccttgtggttgcctgtgagatccaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctgggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttgtggactaaagaggatggacatagaacttccacctctgctgtccctaacctgtttgttccattgaacactaacccaaaagaggtccaggagatgaggaacaagatccgagagcagaatttacaggacattaagacggctggccctcagtcccaggttttgtgtggtgtagtgatggacaggagcctcgtccagggagagctggtgacggcctccaaggccatcattgaaaaggagtaccagccccacgtcattgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcg

SEQ ID NO: 105069 - DNA, 704 bp, Homo sapiens
  Payload ID: 616
  Gene Symbol: ADD1
  Gene Name: adducin 1 (alpha)
  ENST ID: ENST00000510101
  CDS Start-End: 174-383
ggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctgtcttggtatggtgactcctgtgaacgatcttagaggatctgattctattgcgtatgacaaaggagagaagttattacggtgtaaattggcagcgttttatagactagcagatctctttgggtggtctcagcttatctacaatcatatcacaaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcc

SEQ ID NO: 105070 - DNA, 491 bp, Homo sapiens
  Payload ID: 616
  Gene Symbol: ADD1
  Gene Name: adducin 1 (alpha)
  ENST ID: ENST00000508277
  CDS Start-End: 64-491
gggaccccggaatcccgcgcgctgcccacgattcgcttctgaggaacctagaaagattgtacaatgaatggtgattctcgtgctgcggtggtgacctcaccacccccgaccacagcccctcacaaggagaggtacttcgaccgagtagatgagaacaacccagagtacttgagggagaggaacatggcaccagaccttcgccaggacttcaacatgatggagcaaaagaagagggtgtccatgattctgcaaagccctaccagagtgaactccgagcaggaacacttcctcattgtcccttttgggcttctttacagtgaagtgactgcatccagtttggttaagatcaatctacaaggagatatagtagatcgtggaagcactaatctgggagtgaatcaggccggcttcaccttacactctgcaatttatgctgcacgcccggacgtgaagtgcgtcgtgcacattcacaccccagcaggggctgcggt

SEQ ID NO: 105071 - DNA, 594 bp, Homo sapiens
  Payload ID: 616
  Gene Symbol: ADD1
  Gene Name: adducin 1 (alpha)
  ENST ID: ENST00000536424
  CDS Start-End: 1-318
gagatgaggaacaagatccgagagcagaatttacaggacattaagacggctggccctcagtcccaggttttgtgtggtgtagtgatggacaggagcctcgtccagagaatctggacgaggctagagaacagaaagaaaagagtcctccagaccagcctgcggtcccccacccgcctcccagcactcccatcaagctggaggaagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagccccgagccagccccagacccagccccggtggctgaagaggctgccccctcagctgtcgaggagggggccgccgcggaccctggcagcgatgggtctccaggcaagtccccgtccaaaaagaagaagaagttccgtaccccgtcctttctgaagaagagcaagaagaagagtgactcctgaaagccctgcgctaacactgtcctgtccggagcgaccc

SEQ ID NO: 105072 - DNA, 406 bp, Homo sapiens
  Payload ID: 616
  Gene Symbol: ADD1
  Gene Name: adducin 1 (alpha)
  ENST ID: ENST00000541843
  CDS Start-End: 1-344
ttgtgagcaccacgggccccaaccccttcaccacactcacagaccgtgagctggaggagtaccgcagggaggtggagaggaagcagaagggctctgaagagaatctggacgaggctagagaacagaaagaaaagagtcctccagaccagcctgcggtcccccacccgcctcccagcactcccatcaagctggaggaaggcaaaacagatttgtatgtgagctgtgaccagaccttgtgccggagccgactactggagatgacagtgatgctgccacctttaagccaactctccccgatctgtcccctgatgaaccttcagaagcactcggcttcccaatgttagagaaggaggaggaagcccatagacccccaagccccactgaggcccctactgaggccagcccc

SEQ ID NO: 105073 - DNA, 9267 bp, Homo sapiens
  Payload ID: 617
  Gene Symbol: ADD2
  Gene Name: adducin 2 (beta)
  Uniprot ID: P35612
  ENST ID: ENST00000264436
  CDS Start-End: 446-2626
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctggatttgaatccaggtcagtctgagtccagagcccttgctcttaacagctatggtgaacagacaactttaatccccaggggtggtggttttcatccaggatttgtctctatgactgttctccattgcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgcagccttttgtgtgcgagttgttctacttcgggggtgatgttgattgcctctgcattcaacacactctattcccttgacaatgaggcctcacttaggcctcattgggtggagtcttgctgcagcattattctgggaatttatgccatgggcccactttctattgatagatgaacctgtcagttggttcattcctcatgcattccaaaaacatgcattgagcttgggtcaagggccaggcatgaggataggcatagttcctgccctcaagaagttcatgagcataggaggtgtatagacaaattgcaaaacaggcaagggtaccaaggtggcataagaaagcatcaattaactatcttggggaccagagaaaccctgagagaagcaatggctgctaaggttttaaaacaaagagtaaatttccagtagaatgaaaggattggcagggcatgccacaatgagggaagaatgtgcaaaggtgtggacgcatgaaatgccatgatgggttccgctgagcaacgtggcattgccagagcatgatgtggaagctcaggggttgaggggtcccttcataggtaggcagggctgaatcctaaggaaactggtaggaagtgtggaggagctagacttgtcatggaaggggtttggagccactggagcctttaaatcaggatagagtcatgatcagaattgcattttaggaaaatccctttggtggctgaatggagactgtggactggatgggcgtgggatggtggcatgggagctatgaggcctttttgaaatgtcaatactaaaacatagttgatggcctgctttacacgatgtttcctctacagcagatagtgagtttccaacacaaaatttatttccataaaagtctttggataaagcaccttaagagggattttcaacaaggagaggggagcattcaaagagctaatgtttccagttttattttgtcttggtgtagaattgctgggagaggtgtccagccatcctgccatttcttcttcccttgcacagaatgtggcacatttagctccaggcttgaggacatgcaccaaatgctacagaaacagacatgtggtccaaacaaatctacaggctattagaaaggaaaggccattttctttggctgtggataaaagttggctgaaaactttgaccaatatctgactggagaaaatgtgtattcaagagctcagatttggtgggcagtaggttcatgtctggttgagctactgtgcttggatgtgccagagaaaagggtaacatttgaaccaatgtgctgctctgtggctggctgagctgggaagtggagaggtttctgagcttatttccatcgcaaggcaggcaggaggagagaggacaagaaggattagtggtttcgcagagacaggcttggctccaacggctccttgcgtagtgttggctgcacccaacagtggtgtgagagaaccgtccataccatgtgaccttcctcccaaactgcagaaagagacaccttctagcccagatctggactccctaagagcctcctggcctgcatgcaacccaagtaactgtcctactttggccagttgaccccctccactctcctataactaaaacagggttcttcctctgtgaacagataagttctttttaaaggacttgggggaaattggatgaagagcagtaagttcttacagtaagaaccccactgtaaagcactgccctctgccactgatccatgtagactgaatttgaatcccattccctgtggatgataccgtcacttgctcatggtgacatggcaagacagtcattcagatgtttggcattgttgtagcagggctactgctagtgtgggggaaaatgctataaatccacttctttgattgccatggatttgaaagaaccatttgcccaacagcatgattcgcctctgaaagtctaaaaataattttcaatttttccatgaaggtatgtggagggtaaacacacagcctacgcataggtctgcatgacatgttttttctttttctttctttttttttttttttttttttttttttagacggagctttgctctttgttgcccaggctggagtgcagtggtgcaatcttagctcactgcaacctctgcctcccggtttttcaagcgattcttctgtctcagcctcccaagtagctggaattacaggagcccgccaccttgcccagctaatttttgtatttttagtagagacggggtttcaccatgttggccaggctggtcttgaactcctgacctcgtgatccacctgcctcggcttcccaaagtgctgggattacaggaatgagccactgtgccagctgacacgttttttcttttgtgtgaattttatgttctagttttgggacaagggtaatcagttcttgactagtgaacaaatgagagaacatttaccccttactcattttacacatgcaggtcagcagaagccctagagttggttggcacagtcgcagttgactgagcatagaggaaacaggtctttttacattctctctcatcactggagctcagttgaactctaagaccttagcactcaaagagtctgaaaagaaatgagggagaggctaaatttaagctctccactcccacagaaaggacagggcaccctacaatctaaaagccagtgaggcagcctatcatctgtttcacatctgttctgaaagggatagtttaatgcaagaagtaagaggcctgtagtgactgtaaactcatgaaatgtgcacattggttatctgtgcacatttccacttgcaccataacataagaaagcgtacatggagtgtaattacttccagaagccccgtctaaccaacctattcagatgtggcacactttctgtcataaatgagagaccacacgtagagctcggtcaccaaggaatgcccaacatccctttacctctcacaatgagcagccacgctcaccgggaagcagtgtggggacttcagtggggtgtcccttagtggagaacacctttcatcatttttatagagacaattcccttgagaatgtaggcttttcatcttaggaacaattaggaagaatctccagctgggagtgttcttatgtatacagaaacaatgggtcgcattggttcatacttaggtgatattaggtttggctatattgatgtttggtgccacttaccttctagattttcccaaaagttgggtcattgctatgggaaattggggcctgcagatgggggagaaatgatcattattggtgcagggaaggggttcaggcagagctggagtctgaggctcagtgtgagaaagcactggcagttttctagtagagtcaggtcctgggctcctctcctcacccactgtgtcccgaactgaggccagctgtgatcggcaaattgcttatctctaggtagtttaaagaaaacgtaagagtttggggggtggtgggagaataactgtagaaagaccctaaactcttctctcccccagcaaattatcttgtataatgtttaaaaacccaaaggccagatctccccttttaacgtgaatcagaaggaggatggcaattggaccaagggcagagtggccacacttgaaacacattataaaatgggaatatatttcagggaaccccacccccacacttccactccacctcacacctgttggtcctgctttgtgggtgattgattgatacccaaggactgccccacctttaaattcctgcaatttatgctgcaaccaacatcttagtgtttgctctctccgggaagaggccaggtgggggagaacatacggtccagagcctgagatcgcctggctggggtgcaggcaagcaggaacccagtctagatagaatgcagtgttctctaaagctatggatggtttcagtgaaatgtctgtgtctgacaatcgtcacgcaagagtacttactgtcttcccttgtacatacattgtctgtgtttagcttttcctagtattgtgaggtttcaaataggggttccatgtaaatactctttctgctactgaaatgccggcccccttgagtatgcatcacccccacagatggttttgcctttctctatgctaacactttttgagccactgacgtgcagatcggtggttagtttcttgggcttttattttgcaattttatatatatacacatattatatatatatatatatttatgggttggttttgtatagttttctgtttgaatctctgagcaccaaagctgccctttgattttcacgagaactttccaaagccacttcctgagccctcctgctgctttggtgtctgacggtgatgctgcggtggcatctctgcccgtgaatttctgtatgtgtgtgctgttacctcacctgcagacatgaccctagtaaatctaacgtgcttggcttccca

SEQ ID NO: 105074 - DNA, 2654 bp, Homo sapiens
  Payload ID: 617
  Gene Symbol: ADD2
  Gene Name: adducin 2 (beta)
  Uniprot ID: P35612
  ENST ID: ENST00000355733
  CDS Start-End: 446-2377
gggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgagacaggacaggaacgagagccaggctctggtccggccgtgtgcgagttcttcagcgttgccctccacatctggagtaacatattggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaa

SEQ ID NO: 105075 - DNA, 3745 bp, Homo sapiens
  Payload ID: 617
  Gene Symbol: ADD2
  Gene Name: adducin 2 (beta)
  Uniprot ID: P35612
  ENST ID: ENST00000403045
  CDS Start-End: 467-2647
catttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcagattacctgagactgggtcatttataatgaacacagatttatttctctcacatctggaagctgggaagtccaagatcaaggcaccagcatttggtgaagccttctttctgtgtcatcccatggcagaagacagaagggcaagagaggaaaccggtccaagcaggatgccttcctttttctgacaggcagcccccagcagtaccatcacaaaccttggtctcttcttgtcaccagcaaagggatgaaggataagtgatgaggagactgaagcacagaggtgaagcagcttgcccaacgtcacactgctgcttagtgatagaggcagtgctagaccccggggctcctgaatgttactgttggaggctcttaacccactgggatcaagaaggtgtcaagagctagactctccctccaggagaatgaacacagacacaaaaccttgcatatatgcttccgggtaaagaacctgcctgcattttggtaccactacgtgctggcctgtcctgggcatgttatatcatgagaaggcagggaaggctgaatcattaaggacatgaatcagattgattctcgtggctttaaaaacaaacactacaggaccagcatgacccgccagcctgttatccacagaggcttgtggtctccattgaaaagaagcaaagacagcacgtcccaactcaaaagattgtgtcatcctaaaggtgaaaggaagagatgatccaagcaaatttaggaccaatagcagactcttcacactgcctggggatagagggaccaccctgggctcctcttactcctggatttacttggatgaccagactcaggacttcatttaaatagaatttggtttcataatggaatcttcagcttgaaatataaatttgtttctgtctccctctgccatctcagcctttcttg

SEQ ID NO: 105076 - DNA, 3741 bp, Homo sapiens
  Payload ID: 617
  Gene Symbol: ADD2
  Gene Name: adducin 2 (beta)
  Uniprot ID: P35612
  ENST ID: ENST00000407644
  CDS Start-End: 266-2446
aaaggtttctggtgatgatgtagcatccgaggctcttaggaaatcggggctgcaagcactggcccctgcttggggatggtgggaccctcgcccggagcgtaacgcctgacagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaa

SEQ ID NO: 105077 - DNA, 3776 bp, Homo sapiens
  Payload ID: 617
  Gene Symbol: ADD2
  Gene Name: adducin 2 (beta)
  Uniprot ID: P35612
  ENST ID: ENST00000413157
  CDS Start-End: 481-2160
gccaggagagctctcatttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttcggggtcttctgtgcctggggctgggttgcaggacccctgagtcctcatacccaccttcccctgtgatcttgggtgccggtgctcttgctgcaaaatggaggccaacctcacaggggtgctgtgaggaccagggaggacaatgtctgatggcccctgtgggcactgggctggagaacagcagcccagcctgcctgcaggagtgatgcggccggcttccgtacctcctgccatggaactccactctgtcctcccttactaccccgtgaagtggggactcataggcttggggctggagactcccaggtgccccaggtgtgcccagccctgagagtctctgacctctgagcctggtatgacatcatccaaccagagctctggaaagatgatcatgtacccatagagaaggggtatatagacaggacccatgctcctacaggatgggaagggacaatattacccacacaaacccacattgagttagaaagtattgtaattgtttttgtgcttgagatagaacagtgttttgtctagtgcttagcaaaaggggtgaagttcagaattctggcatgtgtttgaaatcactgctgctccttgcaaggtagcaatgggcatgacattttccttagcagtaaaaattggggaaatacaggaaatgttcctctctgcagggcaaattgtgatgatgcaatgatttcaggtcaagactgcagcccacagggtgggtgcccattggcaggagaagtgtgaaagttgtatcatcacacttacctccccccaaccccaactcagccaagatggggaacactgaatatcccgcagggtcaagtatagaaatagccatgttctggcgggaggtgagagttcattacaatgagcaacactgttaaaaaaacaaacaaaaatctcccctgccatttataccaagtgctcttctcggagtccctcttcttgggtttttggtcttggattctcggttgactccatgattccctacattaggcctactgtggcctcccttttggaaggggcccaggggcagaagacctggcgggccagggcagggaggactggcagcctccaggctcacctccctttggcttcactctctttgctcctcagcttcagagcactgcatcctcaaaggccaagatgaggatgctgaattaggaaaaaaggctgtggagtctgaattttagttcctatcttgggctagaggggtcaaagaattcctgaagcttatgtaagggccggctggtcagctccctagaaccacgggctccacagaggtggcaaaacccagtgattttgccagtatccctgcagggacctgcggtacaggcaggttgaagatctgagactcaggaaccttggcccctttgtcacttacaactgtgtgtgaaacaggactaacagtttggactgagagcactgaagctgctgtgtgttgtgcatataacttaatgctgtgtgttgtggcttgcactgctgtgggggcggggagggcagtggtggggaatggctggcatgaagcttgcttgagccaatgctatgcttgctgggctttggctgactggctttgggccaccaactgtatttgcatagtgatggcttggaagtgtccatagaagggattgcaataaaggtgtgtcttccttc

SEQ ID NO: 105078 - DNA, 2332 bp, Homo sapiens
  Payload ID: 617
  Gene Symbol: ADD2
  Gene Name: adducin 2 (beta)
  Uniprot ID: P35612
  ENST ID: ENST00000430656
  CDS Start-End: 299-2026
atttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttcggggtcttctgtgcctggggctgggttgcaggacccctgagtcctcatacccaccttcccctgtgatcttgggtgccggtgctcttgctgcaaaatggaggccaacctcacaggggtgctgtgaggaccagggaggacaatgtctgatggcccctgtgggcactgggctggagaacagcagcccagcctgcctgcaggagtgatgcggccggcttccgtacctcctgccatggaactccactctgtcctcccttactaccccgtgaagtggggactcataggcttggggctggagactcccaggtgccccaggtgtgcccagccctgagagtctctgacctctgag

SEQ ID NO: 105079 - DNA, 582 bp, Homo sapiens
  Payload ID: 617
  Gene Symbol: ADD2
  Gene Name: adducin 2 (beta)
  ENST ID: ENST00000447731
  CDS Start-End: 531-582
tttcctcccagcctcgtgcgggaaatggctttaattctgacggcagggctgtgagggactagcgggaacccgagccttttgtcaaggaactgcggcgtcggtggccagtcatccccgccgccgcggagccgctgcactgctgggggatctcccagcagctctgacgagcgcgggctgcagcatgggcagaaaacgctgccctgcagattagctgggtggattttttaagcgcaccccaccccccaaacccataaaataacaaaaccaacccgcagtggccgaccggagatagctaagatgccgcgcaggagagcaccactaacacgaagctcttctgcacatcagactcttaatcaaaggattgggcatatcagaagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggc

SEQ ID NO: 105080 - DNA, 930 bp, Homo sapiens
  Payload ID: 617
  Gene Symbol: ADD2
  Gene Name: adducin 2 (beta)
  ENST ID: ENST00000415348
  CDS Start-End: 251-930
tcccttattcaactgtcttcatttattctgtaaaagtagcagcagctcagccctgaccatctcctctctcacttgtgggagtctcatttagggatcgtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatcca

SEQ ID NO: 105081 - DNA, 721 bp, Homo sapiens
  Payload ID: 617
  Gene Symbol: ADD2
  Gene Name: adducin 2 (beta)
  ENST ID: ENST00000425976
  CDS Start-End: 294-721
cggtgcgaggcgggcttggcggggctgggcgcgtcccccggggcctcgcgatcgctggctgcgcggcgctcagccgcagtggccggccgagcaggtgcggcgtcggcagccgcctacattgagatcggggcaaccggcactttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgact

SEQ ID NO: 105082 - DNA, 997 bp, Homo sapiens
  Payload ID: 617
  Gene Symbol: ADD2
  Gene Name: adducin 2 (beta)
  ENST ID: ENST00000456320
  CDS Start-End: 1-997
atgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagtctacagagagccagctgatgtccaagggagacgaggataccaaagacgattcagaggagacggtgcccaaccccttcagccaactcactgaccaggagttggaggagtacaagaaagaggtggagaggaagaaactagaacttgatg

SEQ ID NO: 105083 - DNA, 874 bp, Homo sapiens
  Payload ID: 617
  Gene Symbol: ADD2
  Gene Name: adducin 2 (beta)
  ENST ID: ENST00000522886
  CDS Start-End: 36-874
gagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgagacaggacaggaacg

SEQ ID NO: 105084 - DNA, 4337 bp, Homo sapiens
  Payload ID: 618
  Gene Symbol: ADD3
  Gene Name: adducin 3 (gamma)
  Uniprot ID: Q9UEY8
  ENST ID: ENST00000277900
  CDS Start-End: 366-2390
ggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 105085 - DNA, 3081 bp, Homo sapiens
  Payload ID: 618
  Gene Symbol: ADD3
  Gene Name: adducin 3 (gamma)
  Uniprot ID: Q9UEY8
  ENST ID: ENST00000356080
  CDS Start-End: 368-2488
ggggcgctcggctagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaa

SEQ ID NO: 105086 - DNA, 3114 bp, Homo sapiens
  Payload ID: 618
  Gene Symbol: ADD3
  Gene Name: adducin 3 (gamma)
  Uniprot ID: Q9UEY8
  ENST ID: ENST00000360162
  CDS Start-End: 378-2402
agtccacaaaactccctgattccatcctctctgcctcttatgaagcaatactagagaggaaaaacaaaacccattcctttaagaaagattccgcctcctctcataagcaagcgcctaatggtaattgtagagtttactaagtcaaacacttactactcagcattgagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggc

SEQ ID NO: 105087 - DNA, 2394 bp, Homo sapiens
  Payload ID: 618
  Gene Symbol: ADD3
  Gene Name: adducin 3 (gamma)
  ENST ID: ENST00000611329
  CDS Start-End: 125-2143
gaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcaaatacatggcacaaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattat

SEQ ID NO: 105088 - DNA, 947 bp, Homo sapiens
  Payload ID: 619
  Gene Symbol: APRT
  Gene Name: adenine phosphoribosyltransferase
  Uniprot ID: P07741
  ENST ID: ENST00000378364
  CDS Start-End: 46-588
ccgcgcaggcgcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaagagccgtctcctgtcctcctgttccccagggcagggagccccaggacaacaccagacttcagctgtactgtgggcatgtgctgcttggcgtgatgcccagcagaacctgtcctggttctcacctcaggag

SEQ ID NO: 105089 - DNA, 664 bp, Homo sapiens
  Payload ID: 619
  Gene Symbol: APRT
  Gene Name: adenine phosphoribosyltransferase
  Uniprot ID: P07741
  ENST ID: ENST00000426324
  CDS Start-End: 27-431
ctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 105090 - DNA, 788 bp, Homo sapiens
  Payload ID: 619
  Gene Symbol: APRT
  Gene Name: adenine phosphoribosyltransferase
  ENST ID: ENST00000569616
  CDS Start-End: 1-487
ggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacact

SEQ ID NO: 105091 - DNA, 470 bp, Homo sapiens
  Payload ID: 619
  Gene Symbol: APRT
  Gene Name: adenine phosphoribosyltransferase
  ENST ID: ENST00000567713
  CDS Start-End: 25-470
gccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaagctgtgtttcagccacactgaacccaattacacacagcgggagaacgcagtaaacagctttcccacaagagccgtctcctgtcctcctgttccccagggcagggagccccaggacaacaccagact

SEQ ID NO: 105092 - DNA, 709 bp, Homo sapiens
  Payload ID: 619
  Gene Symbol: APRT
  Gene Name: adenine phosphoribosyltransferase
  ENST ID: ENST00000563655
  CDS Start-End: 22-483
gctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttccca

SEQ ID NO: 105093 - DNA, 542 bp, Homo sapiens
  Payload ID: 619
  Gene Symbol: APRT
  Gene Name: adenine phosphoribosyltransferase
  ENST ID: ENST00000568319
  CDS Start-End: 39-230
ggcgcgctcgggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 105094 - DNA, 667 bp, Homo sapiens
  Payload ID: 619
  Gene Symbol: APRT
  Gene Name: adenine phosphoribosyltransferase
  ENST ID: ENST00000567391
  CDS Start-End: 30-221
gggctgccgctggctcttcgcacgcggccatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 105095 - DNA, 10151 bp, Homo sapiens
  Payload ID: 620
  Gene Symbol: APC2
  Gene Name: adenomatosis polyposis coli 2
  Uniprot ID: O95996
  ENST ID: ENST00000233607
  CDS Start-End: 209-7120
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcc

SEQ ID NO: 105096 - DNA, 2394 bp, Homo sapiens
  Payload ID: 620
  Gene Symbol: APC2
  Gene Name: adenomatosis polyposis coli 2
  ENST ID: ENST00000238483
  CDS Start-End: 203-2394
ccggattgcctggccaccaccacgtgggcctgtacttgtccacaccagtgactcctgcctgagaccccccccaacccaggatcaggcaggacggctggggcttaggtcaggggccgtctgtccggaaggcatcaccgcgccctccccagaccatcagctgaaccctctgaccctgtgatcccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgc

SEQ ID NO: 105097 - DNA, 11656 bp, Homo sapiens
  Payload ID: 620
  Gene Symbol: APC2
  Gene Name: adenomatosis polyposis coli 2
  Uniprot ID: O95996
  ENST ID: ENST00000535453
  CDS Start-End: 1714-8625
gggtttggggagcaggaggcagacatgtgttgctttgcacgtcatctggtccttccacctggctgggcatgggatggtgacctcagctggaacatggggctcgagccagaccccagggtctccctgcgtgtagcccccaaccccaagcctgatccccactggagacctgaacagccttggacatcatcggatcagggtgggaggtgccagcctctgccacctgacttccagtccctgtgcccctcccaccctgcccttgggcactcctgccctgcaggttcctcagaggggcaacccaaagccagagaggggcgggtcttgtcgggcctccagcctggacttcccagcccctctggggcagcatctgggtgccagacctcggttcctagggcctcgtttctccctctgggaacagccaaatggtggtccctgagactcaggacagaccaagaaggagccggatgacatggcaagccacacactgcgtcccctgagcaggacgggacagcccgactccatcctcccacctgcgactgagcccccacccctactcctgtcccagccgtgcccctggtgacatttgggtgggaggggaggggatgagggggcacctgggggtcagagaacaaatgacgggtgaatacatgtgtgtggccaggtggaggagggaggggaggagcaggtgggctggacagggccggtgtgaggaaggggctcaggctggcagggggaggtggcagagggatgggctgccattggtgcgtctgagacaaaggcggagggaggaggcgagcgctgatgggaaaggaacaaagagggaaggggggcgtgaaggggggctccggcgggagggccgagccgagggaggaggcgccggccagctggacagagggaggaggccaggccagagccagaagacggccagaggcacaaagaagccagcgcgctggcagagtcaagggatggggcaggggctgccggggccagcagggaccagctgaaggctgcgcagggggtgcgggccacacaggtagccaccctgagctcagccaccgatggagggtcgtggggctgctgcggtgatggcggtgggcttgggtccatctgtcctgccgtttctgcacagcttaggtgtcacccactggccttcgtggtgttttcattgtccatcggcagggacagctggtggtctgtccgccccgcgtgtctggctgtcagcctctgggcaggcttgcttttatgggggagggtcctgtctgtctgtctgtcgccctctctggctgtgagcctgggggtgctgggctggccagtcggcttgctgggttaggctgtcccagctgtctgtgtgtttgtccggctgtcaggatgtgtcctgggggctgggaaggagaggccgacccatcgtctgtcggtcgactggtcagttggacgttcagctgtctgtacgtctgtctgctggcccctctgtctccccttggggccacctctcactccacctgcccctctgcgccccggattgcctggccaccaccacgtgggcctgtacttgtccacaccagtgactcctgcctgagaccccccccaacccaggatcaggcaggacggctggggcttaggtcaggggccgtctgtccggaaggcatcaccgcgccctccccagaccatcagctgaaccctctgaccctgtgatcccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcaccaggcggccgccaccgccgtgtccccaggcagctgcgtgcccagcctgtacgtgcgcaagcagcgggcgctggaggccgagctggacgcacggcacctcgcgcaggcgctggagcacctggagaagcagggcccgccggcagccgaggccgccactaagaagccgctgccgcccctgcgacacctggacggcctggcccaagactatgcttccgattcgggctgctttgacgacgacgatgcaccgtcatccctggctgcggccgcggccaccggggagccagccagccctgccgcgctgtccctcttcctgggcagccccttcctgcaggggcaggcgctggctcgcaccccgcccacccgccgaggcggcaaggaggcagagaaggacaccagtggggaggcagccgtggcggccaaggccaaggccaagctggcgcttgcagtggcgcgcatcgaccagctggtggaggacatctccgccctgcacacctcgtccgacgatagcttcagcctcagctctggagacccgggacaggaggcgccacgggagggccgcgcccagtcctgctcgccatgccgcggcccggagggcgggcggcgagaggcaggaagccgggcgcacccgctgctgcggctcaaggcggcccacgccagcctctccaacgacagcctcaacagcggcagtgccagcgacgggtactgcccacgcgaacatatgctgccctgcccgctggccgcactggcttcgcgccgcgaggaccccaggtgtgggcagcctcggcccagccggcttgaccttgacctgcccggctgccaggccgagcccccggcccgcgaggccacctccgccgacgcccgcgtgcgcaccatcaagctgtcgcctacctatcagcacgtgccactgcttgagggtgcctcaagggcgggtgcagagcccctcgcggggcctggaatctctccaggggcccggaagcaggcctggctgccggcagaccacctgagcaaggttcccgagaagctggcggctgccccgctgtctgtggccagcaaggcactgcagaaactggcggcgcaagaggggccactctcgctgtcccgatgcagctccctttcctcgctgtcctcggccggccgcccaggccccagcgagggtggtgacctggatgacagtgactcctccctggaggggctggaggaggccggccccagcgaggctgagctggacagcacgtggcgggcgcccggggccacctcgctgcccgtagccattccggctccccggcgtaaccgaggccggggcctgggggtggaagacgccacgccgtccagctcgtcggagaactacgtgcaggagacaccgcttgtgctgagccgctgcagctctgtgagctcgctgggcagcttcgagagcccgtccatcgccagctccatccccagtgaaccttgcagcgggcagggcagcggcaccatcagccctagcgagctgcccgacagccccggacagaccatgcctcccagccggagcaagacgccaccgctggcgcccgcgccacagggtccccccgaggccacccagttcagcctgcagtgggagagctacgtgaagcgcttcctggacatcgccgactgccgggagcgctgccggctgccatctgagctggacgcaggcagcgtgcgctttaccgtggagaagccagacgagaacttctcgtgcgcctccagcctcagcgcgctggccttgcacgagcactacgtgcagcaggacgtggagctgcggctgctgccctcggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggagggcgccaattcaattgtcacgtggctgcaccaggcagcagctgccacgcgggaggcctcgtccgagtccgactccatcctgtccttcgtatccgggctgtcagtgggatccaccctacagccccccaagcacaggaagggacgacaggcggagggagaaatgggcagtgcccggcggccagagaaaaggggcgcagcctcagtcaagaccagcgggagcccccgttcccctgcaggccccgagaagccacgtggcacacagaagaccacgcccggggtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggcggcgcatccgagatgaggacgtgccccacatcctgcgcagcacgcttcccgccacggccctgccactgcggggctccacgcccgaggacgccccggccgggcccccgccgcgcaagaccagcgacgccgtggtccagaccgaggaggtcgccgcccccaagaccaactccagcacgtccccgagcctggagaccagggagccccccggggcccccgccggcggccagctctccctcctcggcagcgacgtggacggtcccagcctcgccaaggctcccatctccgcacccttcgtgcacgagggcctgggggtcgccgtggggggcttccccgccagccggcacggctcccccagccgctcggcccgagtaccccccttcaactatgtgcccagccccatggtggtcgcagccaccaccgactcggccgcggagaaagccccggccactgcctccgccaccctcctggaatagtggcctaggccggccttctggaacgttctctcccggccctgcggcgcggtctggctgccccatgggcctgcgctgtagacgtcccccataggtcgccccagggcctctgcccacccgagccccaccactctcagaacccccgcccagcgcacggcgacctcgcgcctcaccggaagaccttgcctctgtgccgcggaggtccaggaggaaacggggcggccgctaggcctcaagtcccgaccgtggagcgctggcaagggcgtcctggcccagccctgagcgcgcggcccttcccctgtcggaagccgttgcttgaccccgggcgagggaggcggtagcctccgggtccgggtctgggtctgggtccgctgcttcgcagggacagcgctggggaggtgacggcgcccgccgcaggtggggcgaggctgggggagggcggcgccgcggcgggcctgccagctgggggcctttgcggcgcgcaggggcgaagcctgtaatcactgcagccgccggtaattcgctaatgagggctttgcagggattgttttcattctcagccccagctgtgggagtgcgggtgggggtgtggccgagccccggcaggaagccccgcccagacggtgttcagggaacccggagcccaagcgctccggcggagcccaaaagggtgggggtgggaggggcagaggccaacggatccccctgcctgtcgcaccccttggcgggagacgggaaggcagcgggctgcgtacgatgggaccctggtgcagacgccgggccggctgacatttggaccccatcccagaggagatgctggctaccagctggggcgaccccaagggtcgctggagtcagtatcggcccggcgcagccgcggcgggcgaggccaatggaaaggagactgaggggagtcccggcagtgagcccgaggccctgggacctggagcccgcgctggcctctccccagcggagcctgcacgttacggagaccatcacatgtgggcgtggtcagtgcccaggaccgcaccgctgctcatcttgtcccttttcaattcccttctggttcatgatgcataaagcgctaggccctagaactccagaaacagcacagctggggcggggacccagccttgccctccacccgaggctctgggacaaggcgggaggttcgggggccttccggcaggtgaacgcagggctggagagtatttggtgccagatgaggtgaaagcttatagaagggcctgaggggctcggctgcctcatcccctggcgggggaggctgggagctgggcctcctgcgtggggtgggactcgcaggggccgggtctccgtgactggggcaacgcctcgtcctgcagagggagccgacgacctcttttctgcagaaaagctccagcaggcgctgccttcacccacggatctgcccaggctgaaggcacacgctcaatgccccacgtgccttctccaggaggaacgaagcagggtttgagggttgggtggatggagctcagaaggaaaccccagccccaccacggatgacaccatccctcccgtcccatccccagcatgggcaaggccagcctttctggcagaaggagctgtcctcaactcagggccgctgtgagcaaagctgaccccagcccccacccccagttaacactgctgcttctctgaatgcatgtcacgctgcaccccatgctccgggcccacaccctgcaggacaaggagctccagacaggacgtccataagtcaccgaggtgtgccacccagcaggtgctggaggtgcccaatgctccctcctaggacctcgcagccaggcaaggctgtcaggttgttttgggggaagagggggtcatggatggctgagcagagagcggggaaaatgcaggctgagtggggcgacctcctgcctgccaggagccccctttcaggacacagcgggggtctcacacttgctgtccccatccatggcccgagggggaacctggtggtctcttctgagcttttggacttggggatgccaaacacgtgctcaccctcacactcgccccggcccgctgcgcccctaattgccaaagggtagggaaatggcgaagccagccaccaggtcgctggtgacagggccagggttatgcaggaaggtggtgcggcattgccttccacatatgtaagtctctgggcggcgccctcccagctccctgcctctgtttccccatgtgggccgtggggaactcccagagctacctcttgggggagcgtggtggcagcgatgatggggagacgcctggaagctcacagaacttgggtctggctggctcctgcccgtgacgccttgcccagcagcaaggtgcgcaacatggctgccagccccgcctcccacccccaccccgagtcctgagctcactttcgccttctccatcccctgccgtgggggccacagccacacctcaccgcccagtccagctgtctccagaaggggacaggcagtccgcggtctctggacaatcaactcaaggtacgcccactgcaaggcctccctcccaccgcggcccctgcctggccacctggcctctctgcaccagggtgacaaggggtcctcgtctgccccccaatgctccagggccagtcctaaggagctgagggtctgaggacgcagggagggtggaggtgtcctgaggctgatggacagtgaccgccactggcccccaacatgaccacacgtgggtgctgaactcggggcgccgtgcccaccggcatggtcctcccgagctccgacagcattacctcacccggccccatctgttgccccggtccagccctgatggcgcgcgcctggtctgtctgattcccctagccgccaccccacgtttctgtaccgggtctctgcagtgttaaacggacgtgtaaatagtggtaaatagtgaaagcctgtccttccctaaatgtaaagccatctgtccggcgtaaggacgacaccgtcagctgtccgactcgcacacatttaataaactgagctcttgcattgcc

SEQ ID NO: 105098 - DNA, 781 bp, Homo sapiens
  Payload ID: 620
  Gene Symbol: APC2
  Gene Name: adenomatosis polyposis coli 2
  ENST ID: ENST00000590877
  CDS Start-End: 201-781
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgttctcgatgcagatggacctgatccggcagcagcttgagttcgaggcccagcacatccg

SEQ ID NO: 105099 - DNA, 568 bp, Homo sapiens
  Payload ID: 620
  Gene Symbol: APC2
  Gene Name: adenomatosis polyposis coli 2
  ENST ID: ENST00000587869
  CDS Start-End: 59-568
gctcctgagcctgctgcactcggccttcttcggggaccagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccg

SEQ ID NO: 105100 - DNA, 2316 bp, Homo sapiens
  Payload ID: 620
  Gene Symbol: APC2
  Gene Name: adenomatosis polyposis coli 2
  ENST ID: ENST00000590469
  CDS Start-End: 209-2316
gcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcggacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggcaggtgctccgggatcacaactgtctgcagacgctgctgcagcatctgacttcgcacagcctgaccatcgtgagcaacgcgtgcggcacgctctggaacctgtcggcccgcagcgcccgtgaccaggagctgctgtgggacctgggcgccgtgggcatgctgcgtaatctggtgcactccaagcacaagatgatcgccatgggcagcgccgccgccctgcgcaacctgctggcccatcggcccgccaagcacca

SEQ ID NO: 105101 - DNA, 555 bp, Homo sapiens
  Payload ID: 620
  Gene Symbol: APC2
  Gene Name: adenomatosis polyposis coli 2
  ENST ID: ENST00000587149
  CDS Start-End: 140-555
gccagaagacggccagaggcacaaagaagccagcgcgctggcagagtcaagggatggggcaggggctgccggggccagcagggaccagctgaaggctgcgcagggggtgcgggccacacagacgctgcaggagctgaagatggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtg

SEQ ID NO: 105102 - DNA, 3809 bp, Homo sapiens
  Payload ID: 621
  Gene Symbol: APCDD1
  Gene Name: adenomatosis polyposis coli down-regulated 1
  Uniprot ID: Q8J025
  ENST ID: ENST00000355285
  CDS Start-End: 355-1899
gaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctatttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaacctatttttacatcatttgtcttaccttgttgagagaggagactggcttgttggcttctggttgttgcaggaggcatgtggcttcctgccttctcagtagacaggatcattaggaaaatagcaacatcaatcctgttacacaggagcagtgacacgggtggctgcagtgtggtacatgccacacaaatgatagagaaagtgcccgttcattgcagtttcctcttcctgggggacctgagccctgactcactgtcttattaggggcaggcggaagaagctgcactctggcatccatgccaccttctaagatgaacatgcagagacagaacttcagctgctcagagagagtgcagtgggcatggtctgccctgggggcttgctccattacaccctgacttggcatgcaaccgagtctttgtgtaaagccatcctgtcattgcacatactggctcactcagtgtctttcctgctgctgatgtggctctgtgctggcagtttcagggtcagtgtgctgctttcctagggacattagaagggcgcaggagtgcatgtctgcccattcctttggagtatcgcagatgatgctatacgataccaagtgttaccgctcacagagactgggaaagggaaatgggagtaaccgaaagccagatggaacgaaagcaaacatggaaaccatgatcacggcaaagagccatccttgtatttaagaagtaactttggccaggtgtgatggctcacgccgtaaccccagcactttgggagaccaaggagggtggatcacgaggtcaggagatcaagaccatcctggctaacactgtgaaatgctgtctctactaaaaatacaaaaaattagccaggcgtggtggtgggcacctgtagtcccagctactcgggaggctgaggcaggagaatggcatgaacctgggaggtggagcttgcagtgagccgagattgtgccactgcgctcgagcctgggcaacagagcgagactccatctcaaaaaaaaaaaaaagtaactttatgaaatgccacagcattcagtgtggcattaagttacaacgaccacatagagtaccaaagtgcttcaggttatattttaagttgtggtgcagactgagggggcttattcaaaatgaaaatactaacttaaatggccaccaagttcaataaacaaagatgtcaaaatactctcagaaatacaactgatactatctttaaaagacgtaataaaatcatgtgaaaaactgt

SEQ ID NO: 105103 - DNA, 833 bp, Homo sapiens
  Payload ID: 621
  Gene Symbol: APCDD1
  Gene Name: adenomatosis polyposis coli down-regulated 1
  ENST ID: ENST00000423585
  CDS Start-End: 147-332
gccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctc

SEQ ID NO: 105104 - DNA, 559 bp, Homo sapiens
  Payload ID: 621
  Gene Symbol: APCDD1
  Gene Name: adenomatosis polyposis coli down-regulated 1
  ENST ID: ENST00000578882
  CDS Start-End: 1-555
atgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccagggtcatgggaggcaccgagttcgtgttcaaagtgaatcacatgaaggtcacccccatggatgcggccacagcctcactgctcaacgtcttcaacgggaatgagtgc

SEQ ID NO: 105105 - DNA, 730 bp, Homo sapiens
  Payload ID: 621
  Gene Symbol: APCDD1
  Gene Name: adenomatosis polyposis coli down-regulated 1
  ENST ID: ENST00000582723
  CDS Start-End: 99-167
gccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacgctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcgg

SEQ ID NO: 105106 - DNA, 744 bp, Homo sapiens
  Payload ID: 621
  Gene Symbol: APCDD1
  Gene Name: adenomatosis polyposis coli down-regulated 1
  ENST ID: ENST00000579685
  CDS Start-End: 1-285
ccagaggatgttctaccggccctccagttaccagccccctctgcagaatgccaagtggagatggggtttcaccatgttggccaggatggtctccaactcccgacctccagtgatccgcccgccttggcctcccaaagtgctgggattacaggcgtgagccaccgtccgcccggccgccatctttcaaatgatctcagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtc

SEQ ID NO: 105107 - DNA, 2218 bp, Homo sapiens
  Payload ID: 621
  Gene Symbol: APCDD1
  Gene Name: adenomatosis polyposis coli down-regulated 1
  ENST ID: ENST00000584596
  CDS Start-End: 1-682
ggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagtgtgcagcggagtcttcaggaagttttcagatccttccccaggacagctctgagaaggaacaaaatggactcagccattggtgtctttccagacccgggcaccagaaagactgggcactgtgtgcccacgcgggcccagccacagcaggttgtccgagctgtctgtggccgccagcggagacaggaagaaaggctgggagaacgtcttcaaagaccgtacacgcctgcccaggagaggctggaacctcctcctttgaactcttctacttccctaattgctggtccatagagaccaagctgaaaattagtttaaatgctaaattgagtttcaaaccacgagcctcagcccctctagaaacaggacaccgtgtaaaaatagaaactttaagtcaacttgtttttctaagctttatacagctttgctgtgaggtccagagtcctttggcaaataagtgacgtttgaagagattcaggtgtgctgggagggttcattcaggatggaactggctactcttcattataaaaaagtcaagacagcgtaaagtaaccctgaaagaagatgctttgcctgaatcaagtttagcgtcagagcagccataatcctctgccgagattcttcagaactatgcagttggaggggtagaagccaggctcattctttcagggatggaatcaaatggtaattaaaagcaaatgattgccaaggtcgttagagatgccagagcctcaggatcagactcgtaagcaaatggaattggtctttctccaaaatcctgcactgatttaaccacaggatcgtaaatcaaaggggctgtctgaaaaccagacagccttccccaggctgtgcatctgaaatactcgatcccagcacatgtacagcaggggagctacacacgggagggagaaaagcaccgggctttgggagtacctgagaactgcagaaaaagagcatgctgtgctttctctctcaaattctttaggagccgctaggctggagccagcatatgtttttgaggtagcttgcctctcagaggctttttagaggatgtgtgacctgtgcagcttcctgatgtcagtgacaccatggggatgttgagtcaggtggtcttggagcctggacttttcagcctagctgcaggagccagcatggagggacgtctcctgagcatgtgcttggtgtggctcctgggtgggtgggcggctgcgtctctggggtatagaaggagccaggtgcttgtggaagaattccataccacttttctttctgctagtgtggatttgcagaggtgatgggagatggacgaggtggtggacaaccagaagttcaagaagtcatgacctaagacagtttcaagaactagtcttacaggaaggagaaccctagaagaaaactgtgactgctccctggagccaggtgtttcctataaggcagcaaatgttgcacaattctatgaaaaaacagagctggcaattgggataggttgagggggtcttgaccctgaaggggttgcttttgtggaccttttatctgggccgaggtgtgcagtgtcacaatcactgggctacaaggctgctgatagacacttctattgcagaaacagctcattatatttcttgactccagagtatttcagcagataaacaggcatgcaaggttgctttatttaaggagttaggggaccaggaaatatttgttgtcagggacaatgcaagtggtaaatattttatcccttaaaaggcaagaaagctcagaggacatgaggaaaccctgcaaaagcaggaaattggccatttaaaaagtacgcatgaggtccctactccagggagtgtttgctgagccccaggggagaaaggaagaggatgggccagccaggagtgcccagtggatttacagcagatttaataagtctactttaattatttaaatgaatcaaaatgcataggagtggaagaaagaaacaagtaaaaagaaataaaaattcttttcggaaa

SEQ ID NO: 105108 - DNA, 3426 bp, Homo sapiens
  Payload ID: 622
  Gene Symbol: APCDD1L
  Gene Name: adenomatosis polyposis coli down-regulated 1-like
  Uniprot ID: Q8NCL9
  ENST ID: ENST00000371149
  CDS Start-End: 232-1737
ccacctcttctggcaagttggacctatgagtgcgcagctccgcttacaactatcaacagccgggaaggctgagcgcgtgtgagcgccgaggggggcgcaggaccctcgcaacttcttcgcaggactccagcctggccgccggcgcccgcagccgtccgagagccctgcgcccgcgcctccccttgcgcaccgtggcagcgcccggcgggcggtcctgccagccccgacgggatgcccgcagccatgctcccctacgcttgcgtcctggtgcttttgggagcccacactgcaccggcggctggggaggccgggggcagctgcctgcgctgggaaccccactgccagcagcccttgccagatagagtgcccagcactgcgatcctgcctccacgccttaatggaccttggatctccacaggctgcgaggtgcgcccaggaccggagttcctgacccgcgcctacaccttctaccccagccggctctttcgagcccaccagttctactacgaggaccccttctgcggggaacctgcccactcgctgctcgtcaagggcaaagtccgcctgcgccgggcctcctgggtcacccggggagccaccgaggccgactaccacctgcacaaggtgggcatcgtcttccacagccgccgggccctggtcgacgtcaccgggcgcctcaaccagacccgcgccggccgggactgcgcgcggcggctgcctccggcccgggcctggctgcctggggcgctgtacgagctgcggagcgcccgggctcagggggactgcctggaggcgctgggcctcaccatgcacgagctcagcctggtccgcgtgcagcgccgcctgcagccgcagccccgggcgtcgccccggctggtggaggagctgtacctgggggacatccacaccgacccggcggagaggcggcactaccggcccacgggctaccagcgcccgctgcagagcgcactgcaccacgtgcagccgtgcccagcctgtggcctcattgcccgctccgatgtgcaccacccgcccgtgctgccgccccctctggccctgcccctgcacctgggcggctggtgggtcagctcggggtgcgaggtgcgcccagcagtcctgttcctcacccggctcttcactttccacgggcacagccgctcctgggaagggtattaccaccacttctcagacccagcctgccggcagcccaccttcaccgtgtatgccgccggccgctacaccaggggcacgccatccaccagggtccgcggcggcaccgagctggtgtttgaggtcacacgggcccatgtgacccccatggaccaggtcaccacggccatgctcaacttctctgagccaagcagctgtgggggtgcgggggcctggtccatgggcactgagcgggatgtcacagccaccaacggctgcctaccgctgggcatccggctcccgcatgtggagtacgagcttttcaagatggaacaagaccccctcgggcaaagcctgctcttcatcggacaaaggcccaccgatggctcaagtcccgataccccagagaaacgtcccacctcctaccaagcacccctggtgctctgtcatggggaggcccccgacttctccaggccaccgcagcacaggccatcgctgcagaagcaccccagcacagggggtcttcacatagcccccttcccacttctgcccctagttctagggctggccttcctccactggctatgacattggacttgacatcaggatggcggctctggacacccattcaacccttcagactccctcctggcagctgtagggaaggaaccattctcctctgctctgtcatggatggatgcacagccccactgcttccaaactctgcctgtgtcccatgtggctcaggacatgagcttaacccctgcaaagcctataccacatcccacagcccgggtccccagtcaagcacttggatgcggcagtgatgttcatcgctacgtgagtttctaaagatcactcccaatttttctactttcctcatccttggcagctcgccaacaggtgcagtcagggggccacacggaacacccccatcccatgttccccccagttcttcccatcctgacccttgggattccaagatgggagcaagaggagatcctgaggctctgcctagggacgaggcctacagttctgccatgtctgtaggttgttgtttaaagattattaattcgaatttagcaatacgatctctaagtggtgccatgaattaaagatgccacttcgggctttcagtgcttctcagcttttgggcaaagggcttgtgtcttcaggggcagctcagctttcctgagtcctgactgctggcattcgtctgcatttgcctgtgcttctgcgagtcggacctcaagctgccaacactgcatgtggataaatccagttttcccgggccagcatgcaaaatgaagaggactccatctaagctgagaagcatggcctccccagagcagcctgcggcctccaagccttcctggcccaggcaaatgccagtgtgcaccaggctggctgctgggggcaggtctttggaggggagcagcatttccagccttctgaacatagttaatagtaatgacagccgtaacactaacgcgctctgcaattcgccctgcccagccatcctcggttgccaagattgcctgtgcctgcctgacaaaggaagagaatctccgaatgtgtatctttgggcccaccctagggagaggtcggggtcaccaggctacatggcgacatctaggcagctccgccttgcccagcctccttgccataatcctaatatattggtgtcctctgctcagaggggactgtcatcatggtgggaacaggctgtgcctccccagggactctgcccatgttcccagggcctcatctgtacactgtgaaattaactggcatcctggtgggcccaagggttttcaggactgggggccaatgactcaccccctccttcctcctcctgatccctatctctagctcttatcacagattttgaacaattgtctgtgaggttaatgatggtttcagagggaagcccttttcctccctgagactgtgtggggttcagtcagcctgctgaaattgcttccacttattacccatccttcctcttaaaaaaaaaaaaagcccaccaagttagtattctctgtagctctcagacagctacaagtgttcctggcatatttaccaaagtacaagaaatcattacattatttacggtctcagactacatcagggttgggggagctcctggtggggatggcagtgggtgtcgatgatatgtccacggctgagcaggtcttgtatccgaagcttgaagtaaccatgccaccatttatcatcaaatttgaaccttttaataaaattaaacagcctgaaaaa

SEQ ID NO: 105109 - DNA, 802 bp, Homo sapiens
  Payload ID: 622
  Gene Symbol: APCDD1L
  Gene Name: adenomatosis polyposis coli down-regulated 1-like
  ENST ID: ENST00000425773
  CDS Start-End: 563-802
gcaaggagcgcatcgctctgccttggccgggaccagagcttgggggaggcctccttgcccactgcgaagactttggggaaggcgacggccaggggacggacatctgggggagggctgggggtctgaatggcaggagctgcaccagggggctgtgcgcgctgcgcgggtgtgcgcgcctcgccgggggctgtctccacctcttctggcaagttggacctatgagtgcgcagctccgcttacaactatcaacagccgggaaggctgagcgcgtgtgagcgccgaggggggcgcaggaccctcgcaacttcttcgcaggactccagcctggccgccggcgcccgcagccgtccgagagccctgcgcccgcgcctccccttgcgcaccgtggcagcgcccggcgggcggtcctgccagccccgacgggatgcccgcagccatgctcccctacgcttgcgtcctggtgcttttgggaggggcccagtcaccactgacaaaaatgacagtaaccacagttgaagtgtgcccagctgggggctcatccccaagcaccctcacattatgaatggctgagaattctggccctggagttagaccacctggctgggaagcccagatcaacatcatatcaacccgtctggctttggcccacactgcaccggcggctggggaggccgggggcagctgcctgcgctgggaaccccactgccagcagcccttgccagatagagtgcccagcactgcgatcctgcctccacgccttaatggaccttggatctccacaggctgcgaggtgcgcccagga

SEQ ID NO: 105110 - DNA, 10701 bp, Homo sapiens
  Payload ID: 623
  Gene Symbol: APC
  Gene Name: adenomatous polyposis coli
  Uniprot ID: P25054
  ENST ID: ENST00000257430
  CDS Start-End: 57-8588
ggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgca

SEQ ID NO: 105111 - DNA, 3602 bp, Homo sapiens
  Payload ID: 623
  Gene Symbol: APC
  Gene Name: adenomatous polyposis coli
  ENST ID: ENST00000507379
  CDS Start-End: 197-3602
caagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatg

SEQ ID NO: 105112 - DNA, 4061 bp, Homo sapiens
  Payload ID: 623
  Gene Symbol: APC
  Gene Name: adenomatous polyposis coli
  ENST ID: ENST00000512211
  CDS Start-End: 148-4061
cttttcctccctggcgacaaggacacatgcattggtggccaaaagagagaggagacaaaaccgctgcagatggctgatgtgaatctagtggaaagagctactggggatgagagaaagaggaggaggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagc

SEQ ID NO: 105113 - DNA, 7406 bp, Homo sapiens
  Payload ID: 623
  Gene Symbol: APC
  Gene Name: adenomatous polyposis coli
  ENST ID: ENST00000508624
  CDS Start-End: 60-923
actggagacagaatggaggtgctgccggactcggaaatggggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagatagaaaagatgaggatgtttgaatgctgatgggaaggagccagtagagaagagagttgaagatccctaagatcaaagagaaatggagagagaaaggatccagagcacatctaaagggatggaccttagataggaggaggggaactctgatgtcacagcaaaaggtggcgatggatatatacgcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaat

SEQ ID NO: 105114 - DNA, 524 bp, Homo sapiens
  Payload ID: 623
  Gene Symbol: APC
  Gene Name: adenomatous polyposis coli
  ENST ID: ENST00000509732
  CDS Start-End: 171-524
gcattgtagtcttcccacctcccacaagatggcggagggcaagtagcaagggggcggggtgtggccgccggaagcctagccgctgctcgggggggacctgcgggctcaggcccgggagctgcggaccgaggttggctcgatgctgttcccaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcattt

SEQ ID NO: 105115 - DNA, 10619 bp, Homo sapiens
  Payload ID: 623
  Gene Symbol: APC
  Gene Name: adenomatous polyposis coli
  Uniprot ID: P25054
  ENST ID: ENST00000508376
  CDS Start-End: 158-8689
gaatggaggtgctgccggactcggaaatggggacacatgcattggtggccaaaagagagaggagacaaaaccgctgcagatggctgatgtgaatctagtggaaagagctactggggatgagagaaagaggaggaggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttg

SEQ ID NO: 105116 - DNA, 817 bp, Homo sapiens
  Payload ID: 623
  Gene Symbol: APC
  Gene Name: adenomatous polyposis coli
  ENST ID: ENST00000504915
  CDS Start-End: 1-817
ctttcatttgatgaagagcatagacatgcaatgaatgaactaggtaggaaggctacccggggcatttcatcacaggagctagggcaggggctttcagggggactacaggccattgcagaattattgcaagtggactgtgaaatgtatgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcgagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacc

SEQ ID NO: 105117 - DNA, 573 bp, Homo sapiens
  Payload ID: 623
  Gene Symbol: APC
  Gene Name: adenomatous polyposis coli
  ENST ID: ENST00000505350
  CDS Start-End: 198-374
acaagatggcggagggcaagtagcaagggggcggggtgtggccgccggaagcctagccgctgctcgggggggacctgcgggctcaggcccgggagctgcggaccgaggttggctcgatgctgttcccaggtactgttgttggctgttggtgaggaaggtgaagcactcagttgccttctcgggcctcggcgccccctatgtacgcctccctgggctcgggtccggtcgcccctttgcccgcttctgtaccaccctcagttctcgggtcctggagcaccggcggcagcaggagctgcgtccggcaggagacgaagagcccgggcggcgctcgtacttctggccactgggcgagcgtctggcaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggac

SEQ ID NO: 105118 - DNA, 2630 bp, Homo sapiens
  Payload ID: 623
  Gene Symbol: APC
  Gene Name: adenomatous polyposis coli
  ENST ID: ENST00000502371
  CDS Start-End: 1-155
tgccagctcctgttgaacatcagatctgtcctgctgtgtgtgttctaatgaaactttcatttgatgaagagcatagacatgcaatgaatgaactaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatag

SEQ ID NO: 105119 - DNA, 2896 bp, Homo sapiens
  Payload ID: 624
  Gene Symbol: ADORA1
  Gene Name: adenosine A1 receptor
  Uniprot ID: P30542
  ENST ID: ENST00000309502
  CDS Start-End: 412-1392
atgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccct

SEQ ID NO: 105120 - DNA, 2919 bp, Homo sapiens
  Payload ID: 624
  Gene Symbol: ADORA1
  Gene Name: adenosine A1 receptor
  Uniprot ID: P30542
  ENST ID: ENST00000337894
  CDS Start-End: 434-1414
gtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctg

SEQ ID NO: 105121 - DNA, 2219 bp, Homo sapiens
  Payload ID: 624
  Gene Symbol: ADORA1
  Gene Name: adenosine A1 receptor
  Uniprot ID: P30542
  ENST ID: ENST00000367235
  CDS Start-End: 185-562
cggaggactatgagctgccgcgcgttgtccagagcccagcccagccctaccgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggagaataagccaatgcatggcaagcactaaatcttagatcctgaagactcagccctcgagcaaaagacatgcacctccccactcaccgggccctggaagaggagggtgctcctcttagaggcccctggaggccaggcgtgcctcagaggggcctttcgaggcagctgggaggcagatcctcacactctgccctcctctcccccaggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctc

SEQ ID NO: 105122 - DNA, 3407 bp, Homo sapiens
  Payload ID: 624
  Gene Symbol: ADORA1
  Gene Name: adenosine A1 receptor
  Uniprot ID: P30542
  ENST ID: ENST00000367236
  CDS Start-End: 922-1902
aacatgaggggattggactggatgccttatggcttagcgctgtgctatgaagaggaagaaggaggaaggaaaaggagcgcagagcgggttacactgccaggagatcctgggaagctaggtcacttccctgagcctcagcatccttatctgcaaaatagaaattgctaatagactaaaaggcaattctgaaagatggatgagaaaggaatataatgactcagggtagagcctgcaaaacaatatgggatgagaagatgcagggactggtttcatggagagagcagggttttaggattgggggagggtgccagggctaccgactgctttgggagatcccagagggggcattctgaagtcctgcagaagagatgctgtgccgtgaggggtgaggggtcgctggaggccagaccagggctcccaggagtcctgcattgagaagggagagagtggacacaggaaggatgcgcctctgtccagtcctgaggctgggcgcacacaccaggcccttcgaaaagctcacattttttccagcttttctcacccagtatcacttcctttgttaagaggagggggtgggggaggagacggaggatgaggagggaggggctggcgggtgccgccgccgcccccgccccctcccggtgtgcggagcccgattgtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatatttgctggagtgctggctccacgccctggggagtgagcttggtgcggtaggtgctggcctcaaacagccacgaggtggtagctctgagccctccttcttgccctgagctttccggggaggagccttggagtgtaattacctgtcatctgggccaccagctccactggcctgcccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggagagtacccccctgagagcatgtgggggaaggccttgctgtcatgtgaatccctcaatacccctagtatctggctgggttttcaggggctttggaagctctgttgcaggtgtccgggggtctaggactttagggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcgagttgaccttctgaacatgagtgtcaactccaggacttgcttccaagcccttccctctgttggaaattgggtgtgccctggctcccaagggaggcccatgtgactaataaaaaactgtgaaccctg

SEQ ID NO: 105123 - DNA, 862 bp, Homo sapiens
  Payload ID: 624
  Gene Symbol: ADORA1
  Gene Name: adenosine A1 receptor
  ENST ID: ENST00000618295
  CDS Start-End: 68-700
tctgttccctggaactttgggcactgcctctgggacccctgccggccagcaggcaggatggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccac

SEQ ID NO: 105124 - DNA, 2569 bp, Homo sapiens
  Payload ID: 625
  Gene Symbol: ADORA2A
  Gene Name: adenosine A2a receptor
  Uniprot ID: P29274
  ENST ID: ENST00000337539
  CDS Start-End: 460-1698
acagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaa

SEQ ID NO: 105125 - DNA, 669 bp, Homo sapiens
  Payload ID: 625
  Gene Symbol: ADORA2A
  Gene Name: adenosine A2a receptor
  ENST ID: ENST00000436735
  CDS Start-End: 477-669
cacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatca

SEQ ID NO: 105126 - DNA, 560 bp, Homo sapiens
  Payload ID: 625
  Gene Symbol: ADORA2A
  Gene Name: adenosine A2a receptor
  ENST ID: ENST00000439591
  CDS Start-End: 331-560
attggaccaggggaaccagccttgctcagtgacttctctgggtgtcctcctctaaagtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctg

SEQ ID NO: 105127 - DNA, 569 bp, Homo sapiens
  Payload ID: 625
  Gene Symbol: ADORA2A
  Gene Name: adenosine A2a receptor
  ENST ID: ENST00000424232
  CDS Start-End: 307-569
gactcccaggcccgaggactcctggaagggaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcac

SEQ ID NO: 105128 - DNA, 1517 bp, Homo sapiens
  Payload ID: 625
  Gene Symbol: ADORA2A
  Gene Name: adenosine A2a receptor
  ENST ID: ENST00000444262
  CDS Start-End: 423-1517
ccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctg

SEQ ID NO: 105129 - DNA, 926 bp, Homo sapiens
  Payload ID: 625
  Gene Symbol: ADORA2A
  Gene Name: adenosine A2a receptor
  ENST ID: ENST00000486108
  CDS Start-End: 602-926
gagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcc

SEQ ID NO: 105130 - DNA, 689 bp, Homo sapiens
  Payload ID: 625
  Gene Symbol: ADORA2A
  Gene Name: adenosine A2a receptor
  ENST ID: ENST00000496258
  CDS Start-End: 440-689
acagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcg

SEQ ID NO: 105131 - DNA, 558 bp, Homo sapiens
  Payload ID: 625
  Gene Symbol: ADORA2A
  Gene Name: adenosine A2a receptor
  ENST ID: ENST00000464977
  CDS Start-End: 540-558
gcagaccggccccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcct

SEQ ID NO: 105132 - DNA, 718 bp, Homo sapiens
  Payload ID: 625
  Gene Symbol: ADORA2A
  Gene Name: adenosine A2a receptor
  ENST ID: ENST00000472248
  CDS Start-End: 631-718
gagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctggg

SEQ ID NO: 105133 - DNA, 1735 bp, Homo sapiens
  Payload ID: 626
  Gene Symbol: ADORA2B
  Gene Name: adenosine A2b receptor
  Uniprot ID: P29275
  ENST ID: ENST00000304222
  CDS Start-End: 333-1331
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgta

SEQ ID NO: 105134 - DNA, 1884 bp, Homo sapiens
  Payload ID: 627
  Gene Symbol: ADORA3
  Gene Name: adenosine A3 receptor
  Uniprot ID: P0DMS8
  ENST ID: ENST00000241356
  CDS Start-End: 407-1363
ctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcttgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcccttgtcctttctctctaattcagtgttttggaggcctgacttggggacaacgtattattgatattattgtctgttttccttcttcccaatagaagaataagtcatggagcctgaagggtgcctagttgacttactgacaaaaggctccagttgggctgaacatgtgtgtggtggtgactcatttccataccattgtggaattgagcagagaacctgctctcggaggatgcctaggagatgttgggaacagaaaaaataaactgagtttaagggggacttaaactgctgaattcacctgtggatgtttttgagtaaataaaagctaatagctaa

SEQ ID NO: 105135 - DNA, 1201 bp, Homo sapiens
  Payload ID: 627
  Gene Symbol: ADORA3
  Gene Name: adenosine A3 receptor
  ENST ID: ENST00000632535
  CDS Start-End: 59-430
ctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagctccatctcccctaccctttagcaattactgctgtggactcactgactctcttcattcacacagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgagaatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctatcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcttgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggag

SEQ ID NO: 105136 - DNA, 1539 bp, Homo sapiens
  Payload ID: 628
  Gene Symbol: ADA
  Gene Name: adenosine deaminase
  Uniprot ID: P00813
  ENST ID: ENST00000372874
  CDS Start-End: 136-1227
ggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtggaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgca

SEQ ID NO: 105137 - DNA, 1356 bp, Homo sapiens
  Payload ID: 628
  Gene Symbol: ADA
  Gene Name: adenosine deaminase
  ENST ID: ENST00000536532
  CDS Start-End: 75-866
cgagcggccaccgagccggcagagacccaccgagcggcggcggagggagcagcgccggggcgcacgagggcaccatggcccagacgcccgccttcgacaagcccaaagtggaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgaggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtg

SEQ ID NO: 105138 - DNA, 1128 bp, Homo sapiens
  Payload ID: 628
  Gene Symbol: ADA
  Gene Name: adenosine deaminase
  ENST ID: ENST00000537820
  CDS Start-End: 85-1104
cagggaaagccgagcggccaccgagccggcagagacccaccgagcggcggcggagggagcagcgccggggcgcacgagggcaccatggcccagacgcccgccttcgacaagcccaaagtggaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttca

SEQ ID NO: 105139 - DNA, 812 bp, Homo sapiens
  Payload ID: 628
  Gene Symbol: ADA
  Gene Name: adenosine deaminase
  ENST ID: ENST00000539235
  CDS Start-End: 85-312
cagggaaagccgagcggccaccgagccggcagagacccaccgagcggcggcggagggagcagcgccggggcgcacgagggcaccatggcccagacgcccgccttcgacaagcccaaagtggaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttca

SEQ ID NO: 105140 - DNA, 1961 bp, Homo sapiens
  Payload ID: 629
  Gene Symbol: ADAD1
  Gene Name: adenosine deaminase domain containing 1 (testis-specific)
  Uniprot ID: Q96M93
  ENST ID: ENST00000296513
  CDS Start-End: 186-1916
aaacaggaaggccacagtggaggccaagccttccccatgggcaccttctcagattgcgattgtggatgaaatgagggattttcttgaaacaaccctcacgcaggtgacgcaagacgcggagctcggctgcacgacgctggcgcaagcgcgggggcaagagcgccggcctccgagacggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 105141 - DNA, 1912 bp, Homo sapiens
  Payload ID: 629
  Gene Symbol: ADAD1
  Gene Name: adenosine deaminase domain containing 1 (testis-specific)
  Uniprot ID: Q96M93
  ENST ID: ENST00000388724
  CDS Start-End: 152-1849
acggttagtgattggacgaagcagggcgcgggggcgcaagcccgggtcctgcaggggcgacgcgaggcctcttttgaaagatgcggccctgaccctgtgaacctcgcgcagagcggcctgaagcgagaggttgaggctgggaggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtgtgttttgactagtaaaaa

SEQ ID NO: 105142 - DNA, 1918 bp, Homo sapiens
  Payload ID: 629
  Gene Symbol: ADAD1
  Gene Name: adenosine deaminase domain containing 1 (testis-specific)
  Uniprot ID: Q96M93
  ENST ID: ENST00000388725
  CDS Start-End: 197-1873
ttgaaagatgcggccctgaccctgtgaacctcgcgcagagcggcctgaagcgagaggttgaggctgggaggtgggagcaacggcggcggcggccgcctgcgagcccccggcctgaggcgcagcagcagctgcccgtcttcccacatagagggcaggaaggacaactttgagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 105143 - DNA, 627 bp, Homo sapiens
  Payload ID: 629
  Gene Symbol: ADAD1
  Gene Name: adenosine deaminase domain containing 1 (testis-specific)
  ENST ID: ENST00000446706
  CDS Start-End: 159-627
gttcgctcactggccaagcttcaggacgtgtgaggtagtttttctgtaaacaggaaggccacagtggaggccaagccttccccatgggcaccttctcagattgcgattgtggatgaaatgagggattttcttgaaacaaccctcacgcaggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaat

SEQ ID NO: 105144 - DNA, 977 bp, Homo sapiens
  Payload ID: 629
  Gene Symbol: ADAD1
  Gene Name: adenosine deaminase domain containing 1 (testis-specific)
  ENST ID: ENST00000439307
  CDS Start-End: 254-977
gagacggttagtgattggacgaagcagggcgcgggggcgcaagcccgggtcctgcaggggcgacgcgaggcctcttttgaaagatgcggccctgaccctgtgaacctcgcgcagagcggcctgaagcgagaggttgaggctgggaggtgggagcaacggcggcggcggccgcctgcgagcccccggcctgaggcgcagcagcagctgcccgtcttcccacatagagggcaggaaggacaactttggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagag

SEQ ID NO: 105145 - DNA, 2283 bp, Homo sapiens
  Payload ID: 630
  Gene Symbol: ADAD2
  Gene Name: adenosine deaminase domain containing 2
  Uniprot ID: Q8NCV1
  ENST ID: ENST00000268624
  CDS Start-End: 94-2091
gtgctccccacgtgaaggcacccgccctgcgcgtgtgaaagggcgagagcagcgcgagatagggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggggcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggaaaagtgttcaaatatagagcccctggaggagaggaattgaaagcaatgtgtctgtggcaggtggaagtgctcagagccttcctcctgagaacagggtggcgtgggctctggagaggggacctggatttgggtcctgactcaagttgggcaaaccgcctgccgtttctgctcatctgtgaaatggagtcacgcatccctgctgtggaggagttgggtccctgcttccccttctcggtgagcgcggaactggatggggtggtctgccctgcgggcactgcgaatagcaagacggaggccaaacagcaggcagcgctctctgccctctgctacatccggagtcagctggagaacccagagtccccccagacctccagccggcctccactggcccccctgagcgtagagaacatcctgacccatgagcagcgctgcgcagcgttggtgagcgccggctttgacctcctgttggacgagcgctcgccatactgggcctgtaaggggactgtggctggagtcatcctggagaggggctgggccgtctctgccccctcctgcacagagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagtgacaagctggcacgctgggccgtgctggggctgggtggtgccctgctggcccacctggtgtccccactctacagcaccagcctcatcctggctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaatgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggtt

SEQ ID NO: 105146 - DNA, 1995 bp, Homo sapiens
  Payload ID: 630
  Gene Symbol: ADAD2
  Gene Name: adenosine deaminase domain containing 2
  Uniprot ID: Q8NCV1
  ENST ID: ENST00000315906
  CDS Start-End: 53-1804
ggcgagagcagcgcgagatagggcctagcgcctcagatcttcgttggcggccatggcttcggcttctcagggcgctgacgacgacggcagtcgtaggaagccccgcctggctgcatcgttgcagatcagcccccagccccgcccctggcgaccgctacccgcccaggcccaaagtgcctgggggcccgcgcccgcgcccgcgacgtatcgcgcggagggcgggtggccccaggtctcggtgttgagggacagtgggcctggggcaggggccggagtcggggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggtccctgcttccccttctcggtgagcgcggaactggatggggtggtctgccctgcgggcactgcgaatagcaagacggaggccaaacagcaggcagcgctctctgccctctgctacatccggagtcagctggagaacccagagtccccccagacctccagccggcctccactggcccccctgagcgtagagaacatcctgacccatgagcagcgctgcgcagcgttggtgagcgccggctttgacctcctgttggacgagcgctcgccatactgggcctgtaaggggactgtggctggagtcatcctggagagggagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcggaaggtggcctcccgcacagcccacccatgcgcctgcaggcccatgtgctcgggcagctgaagcctgtgtgctacgtggcgccctcgctctgtgacacccacgtgggctgcctgtcagccagtgacaagctggcacgctgggccgtgctggggctgggtggtgccctgctggcccacctggtgtccccactctacagcaccagcctcatcctggctgactcatgccacgaccctccgactctgagcagggccatccacacccggccctgcctggacagtgtcctggggccatgcctgccacctccctacgtccggaccgccctgcacctgtttgcagggcccccggtggccccttccgaacccacccctgacacctgccgtggcctgagcctcaactggagcctgggggaccctggcatcgaggttgtggatgtggccaccgggcgtgtgaaggccaatgccgccctggggcctccctcccgtctctgcaaggcctcctttctccgggcctttcaccaggcggccagggctgtggggaagccctacctcctggccttgaagacctacgaggctgccaaggctgggccctaccaggaggctcgcaggcagctgtctctcctcctggaccagcagggcctgggggcttggccctcgaagccactggtgggcaaattcagaaactgaagccagcctcggcgggaccgaggtcccggagccaagctgtacccctgctgggggagtgccctatctgaggagcgttgtggggagaacatgggttgtgcggggtgaaactggggctggagggaaggaggagcctgctgtggttgggaggcggctgctgcacgtttgggcttgaataaagaagtatttctggt

SEQ ID NO: 105147 - DNA, 801 bp, Homo sapiens
  Payload ID: 630
  Gene Symbol: ADAD2
  Gene Name: adenosine deaminase domain containing 2
  ENST ID: ENST00000567685
  CDS Start-End: 1-801
gggaactgggggcagcccgggcgtgggaaaacttgggggaacagatggggaaggccccgagggtccctgtgcccccagcagggctcagcctgccgctcaaagacccacctgccagccaggccgtgtccttgctcacggagtacgcggccagcctgggcatcttcctgctcttccgggaggaccagccaccaggtccctgcttccccttctcggtgagcgcggaactggatggggtggtctgccctgcgggcactgcgaatagcaagacggaggccaaacagcaggcagcgctctctgccctctgctacatccggagtcagctggagaacccagagaacatcctgacccatgagcagcgctgcgcagcgttggtgagcgccggctttgacctcctgttggacgagcgctcgccatactgggcctgtaaggggactgtggctggagtcatcctggagagggagatcccgcgtgccaggggccacgtgaaggagatctacaagctggtggctctgggcaccggcagcagctgctgtgctggctggctggagttctcgggccagcagctccacgactgccatggcctggtcatcgcccgcagggccctgctgaggttcttgttccggcagctcctgctggccacacaggggggccccaagggcaaggagcagtccgtgctggccccccagccagggcccggacccccattcaccctcaagccccgcgtcttcctgcacctctacatcagcaacacccccaagggcgcggcccgtgacatctacctgccccccacctcggaaggtg

SEQ ID NO: 105148 - DNA, 6515 bp, Homo sapiens
  Payload ID: 631
  Gene Symbol: ADAR
  Gene Name: adenosine deaminase, RNA-specific
  Uniprot ID: P55265
  ENST ID: ENST00000368471
  CDS Start-End: 981-3776
cccgactgaaggtagagaaggctacgtggtgggggagggtggggggagggtcgcggccgcactggcagtctccgggtgtccggccgtgtcccgaggaagtgcaagacccggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 105149 - DNA, 6625 bp, Homo sapiens
  Payload ID: 631
  Gene Symbol: ADAR
  Gene Name: adenosine deaminase, RNA-specific
  Uniprot ID: P55265
  ENST ID: ENST00000368474
  CDS Start-End: 201-3881
gaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattctt

SEQ ID NO: 105150 - DNA, 3585 bp, Homo sapiens
  Payload ID: 631
  Gene Symbol: ADAR
  Gene Name: adenosine deaminase, RNA-specific
  ENST ID: ENST00000529168
  CDS Start-End: 1-3585
gggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagta

SEQ ID NO: 105151 - DNA, 6882 bp, Homo sapiens
  Payload ID: 632
  Gene Symbol: ADARB1
  Gene Name: adenosine deaminase, RNA-specific, B1
  Uniprot ID: P78563
  ENST ID: ENST00000348831
  CDS Start-End: 414-2519
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 105152 - DNA, 6604 bp, Homo sapiens
  Payload ID: 632
  Gene Symbol: ADARB1
  Gene Name: adenosine deaminase, RNA-specific, B1
  Uniprot ID: P78563
  ENST ID: ENST00000360697
  CDS Start-End: 16-2241
caaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggagccctgggcggggcggctgttggggggaactgggttcggggtgccctgggcagggggctactggggggcggctgtgaggaggagttgggttcagggagccctgggcggggtggctgtcagggggaactgggttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 105153 - DNA, 3563 bp, Homo sapiens
  Payload ID: 632
  Gene Symbol: ADARB1
  Gene Name: adenosine deaminase, RNA-specific, B1
  Uniprot ID: P78563
  ENST ID: ENST00000389863
  CDS Start-End: 414-2558
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 105154 - DNA, 704 bp, Homo sapiens
  Payload ID: 632
  Gene Symbol: ADARB1
  Gene Name: adenosine deaminase, RNA-specific, B1
  ENST ID: ENST00000449478
  CDS Start-End: 280-704
aaatgtcgctgttcagtgcgttgatcgattctcacatctgaagccagctgtgtattcttgagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtcttt

SEQ ID NO: 105155 - DNA, 5032 bp, Homo sapiens
  Payload ID: 632
  Gene Symbol: ADARB1
  Gene Name: adenosine deaminase, RNA-specific, B1
  Uniprot ID: P78563
  ENST ID: ENST00000437626
  CDS Start-End: 414-2639
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcact

SEQ ID NO: 105156 - DNA, 5033 bp, Homo sapiens
  Payload ID: 632
  Gene Symbol: ADARB1
  Gene Name: adenosine deaminase, RNA-specific, B1
  Uniprot ID: P78563
  ENST ID: ENST00000496664
  CDS Start-End: 414-2639
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggagtgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 105157 - DNA, 4913 bp, Homo sapiens
  Payload ID: 632
  Gene Symbol: ADARB1
  Gene Name: adenosine deaminase, RNA-specific, B1
  Uniprot ID: P78563
  ENST ID: ENST00000492414
  CDS Start-End: 414-2519
gcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcacta

SEQ ID NO: 105158 - DNA, 159 bp, Homo sapiens
  Payload ID: 632
  Gene Symbol: ADARB1
  Gene Name: adenosine deaminase, RNA-specific, B1
  ENST ID: ENST00000611195
  CDS Start-End: 1-159
atggccaatgagcacaccctcattcatccagcgagcattgaggaccccctagaggccaggcccatgagtgatgaagatcccgaggatgaagacgccttgccagccaggtggaagaaagaaatgggaagaaaaaggaagagaaccatagctacgttgtga

SEQ ID NO: 105159 - DNA, 4583 bp, Homo sapiens
  Payload ID: 632
  Gene Symbol: ADARB1
  Gene Name: adenosine deaminase, RNA-specific, B1
  Uniprot ID: P78563
  ENST ID: ENST00000629643
  CDS Start-End: 1-2190
atgaagatcccgaggatgaagacgccttgccagccagacagaaacagtctccgccagtcaagaaaccctcaaaagtattttgccatggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcact

SEQ ID NO: 105160 - DNA, 703 bp, Homo sapiens
  Payload ID: 633
  Gene Symbol: ADARB2
  Gene Name: adenosine deaminase, RNA-specific, B2 (non-functional)
  ENST ID: ENST00000381305
  CDS Start-End: 236-661
agaaaagagagcagcatttgttagcacacatgggcctgtggagcccagtcccaggcaacagtgtccccagagccccagtgatggctgggttgggtctggggcactcccagggagctccccaaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggag

SEQ ID NO: 105161 - DNA, 1810 bp, Homo sapiens
  Payload ID: 633
  Gene Symbol: ADARB2
  Gene Name: adenosine deaminase, RNA-specific, B2 (non-functional)
  Uniprot ID: Q9NS39
  ENST ID: ENST00000381310
  CDS Start-End: 5-751
acacatgggcctgtggagcccagtcccaggcaacagtgtccccagagccccagtgatggctgggttgggtctggggcactcccagggagctccccaaggtccgcacgatgggaagactgacaggtcctcaggaccaggccgcagacggacagagaggaccaggctccctgggctcctgggtggggctccgctgactgctggctctccccacaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaacctttaccttc

SEQ ID NO: 105162 - DNA, 8421 bp, Homo sapiens
  Payload ID: 633
  Gene Symbol: ADARB2
  Gene Name: adenosine deaminase, RNA-specific, B2 (non-functional)
  Uniprot ID: Q9NS39
  ENST ID: ENST00000381312
  CDS Start-End: 327-2546
tgcgctgggagcccagagcaggaggcagagcccgcgggaagctcggagcactcaggacgccgcgcgcccttccccgccctccctgaccagggagcagctcgctccaggcgcccagccgaggcccccagcccagtgggagcaagtcatagagaacaattcgagagacagagagacggagcgcgctttcctgctcagtcctgaaaagtgagccgctcccgggtttgcaacctcaagcttcgcagcagcggcggcggcggctgccgggaaggaggcaggtgcaggtgcaggagggaggcggctctgggctccgcgcctgggtctcggccatggcctcggtcctggggagcggcagagggtctggagggctgagcagtcaactcaaatgcaagtccaagaggaggaggaggcggaggtccaagcggaaagataaagtaagcatattgtcaaccttcctcgctcctttcaagcacctgagtcctggcatcacaaacacggaggatgacgacaccctcagtaccagcagcgcggaggtgaaggagaaccgcaacgtgggcaacctggccgcgcggccaccgccctccggggaccgggcccggggcggcgcgcccggcgcgaagaggaagcggccgctggaggaggggaatgggggccacttgtgcaaactgcagctggtctggaagaagctgtcgtggtcggtggcgcccaagaacgcgctggtgcagctgcacgagctgaggccgggcctgcagtaccggacagtgtcgcagacgggcccggtgcatgccccggtcttcgcggtagcggtggaggtgaacgggctcacgttcgagggcacaggccccaccaagaagaaggccaagatgcgcgcggcggagctggcactcaggtccttcgtgcagttccccaacgcctgccaggcgcacctggccatgggcgggggcccgggccccggcacggacttcacctccgaccaggccgatttccccgacacgctcttccaggagttcgagcccccggcgccgcgccccggactcgcgggaggccgccccggggacgccgcgcttctgtccgcggcctacgggcgacggcggctgctgtgccgcgcgctggacctggtgggcccgacccccgccacccccgcggccccgggcgagcgcaaccccgtggtgctgctgaaccgcctgcgcgccgggctgcgctacgtgtgtctggcagaaccggccgagcggcgcgcgcggagcttcgtgatggccgtgagcgtggacggcaggacgttcgagggctcggggcgcagcaagaagctggcccggggtcaggccgcgcaggccgcactgcaggagctgttcgacatccagatgcccggccacgcgcccggcagggccaggaggacgccaatgccgcaggaattcgcagactccatatcccagctggtcacacagaagttccgcgaggtgacgacggacctcacgcccatgcacgcccgccataaagcgctggcaggaatcgtcatgaccaaaggcctggatgctcggcaggcgcaggtcgtggccctgtcctcggggaccaagtgcatcagcggcgagcacctcagtgaccaggggctggtggtgaatgactgccacgcggaggtcgtggcccggcgggcgttcctgcacttcctctacacgcagctggagctgcacctgagcaagcggcgcgaggactcagagcgatcgatattcgtgcggttaaaagaaggtggctaccggctgcgagagaacatcctcttccatctctacgtgagcacctccccctgtggagacgcaagactccactctccctacgagatcaccacagacctgcacagcagcaaacacctcgtcaggaagttccgcgggcacctgcgcaccaagatcgagtccggggaagggacggtccccgtgcgtggccccagcgcagtgcagacctgggacggcgtcctgctgggggagcagctgatcaccatgtcctgcacggacaagatcgccaggtggaacgtcctggggctgcagggcgcgctcctgtcccacttcgtggagcccgtgtacctgcagagcatcgtggtgggcagcctgcaccacacgggccacctcgcacgcgtcatgagccaccgcatggagggtgtcggccagctgcccgcctcctaccggcacaaccggcctctcctcagcggcgtgagtgacgccgaggcgcgccagccggggaagtcgccccccttcagcatgaactgggtcgtgggcagcgcggacctggagattatcaacgccaccactgggcggaggagctgtgggggcccatcccggctctgcaagcacgtgctgtctgcacggtgggcgcggctgtatggcaggctgagcacacggacacccagccctggagacacgccctccatgtactgtgaggccaagctgggggcgcacacctaccagtctgtgaaacagcagctgttcaaggcctttcagaaggctggcctgggcacctgggtgaggaaaccaccggagcagcagcagtttctactgactctctaggctgcgggctcctggctgctggagctgagcgggacgctggagggatgggaccgtgtctggggggcgacgtggcgggtcggccggttccctgcattcgttttactttggtgtcccagaaacacgcgagtgtgcaatgtttggacgagcaacaacacaaattcagaacgtgcctctttccagatcgctggccccagaaccctgtcccccacacccaggggcacatgcactgttgagttagcgccgactcttcctgtggagtctgagggaggggctccattcaggcaaaggggttttagctgcagccttggaaggaggcaccgacacgacaccaggcaggagtgagcctcaggccccgtccctgcaccccacccctgcgtgcgcctcttggtgatgctggggtctcactagcttgagggggcacatgaagataagccacaaatgaagagaaaagccatgcccaccccagccccagagaaaccaataagaatcctctattattttcactattcatttaggtttttatactccacctcctttcaaaaaagatttaagatgtacgacattaccgaacacctaaaatagaaccagagaaacgaaagccattcccacaaagtgaaggaacagtttccaaaacccctgcgaggcagagttaagacctgtgacgtggggagcctggaaacacccggcccacgcgtgctgcagatgtggggagcctggaaacacccggcccacgcgtgctgcagatgtggggagcctggaaacacccggcccacgcgtgctgcagatgtggggagtctggaaacacccggcccacgcgtgctgcagatgtggggagcccggaaacacctggcccatgcctgttcagtccgtcatggcgtttggtttatggtggccgatactaagagccactgaggtctgggttgtgtaagggttagctaccaccctataacctccctaccaggtaataaggagaccaagtctttgatcaaattctgattttttaactaaattttcattagaaagcaagcacaaaataaaatcaaaacaacctttaccttcagcttgagaggctaccagctctctattctttcagattctccaatcaacaccttgcaggacaagaccccaaaaaagttcagctgtcaaaaaatgtaagaggcaggattctgtgaccctcagagcaggcttccaacaccagagaccttcagctcacagtggagatgggacatgggggctttagcccacagcatcatccctgagagccaaggcgctgtattcatacggggtcaggctcttttccaagtatctttacgtaatccatgtacctcgagctgctgtcatctcacctccgagaactcatttctaacattcatcatgctagatagccagtctctcatttctccaacttaaaaaatccatctctgaaattcatgacagtgatggcagacggcaaagcatggtggtgtccacctctggggtgtgggcttcccggaaagaatcccagctgaccaccccagaaagtgcaagaataacattgtgctgtacatagtcaagtgctataaattacagttatcataatgagaaggcagaaatgaaactgagttgtagctatttgttacaagataataagaagtagagatattagtatggaaaaagaaacttttcctgggatttaaaatcaggccaaatttatcactcgagttcttttagaaaagaaaacaggtactggagtagacaacttcttccagataaagtttcaaaagatacgagaacattttttcaaataaaggactcacattaatcttttataaaaatcacaaaaataaatgaaatcttaattcagtgcaaaagctaagctcaaacgaccagtttctattaagttctggtaacttgacatcactaggatgaagcttagagaacttagagtcgagaggtgatgggtggctcagacattcgcagcagtcagaagtgagcgctcccctgaatgcgtgggagcacggccagctcctggctgaagtctcccacccaggcctcaaatcaccttcatctgagatgttggctagagaagcatataatgctttgtcccagtgggctccaaatcacgctgtttctgcagcgagggggcctgtgttgtaagcagatttcactgtcacagggaagacgcagggtctgattcacgggactcggaaagcgctcggccacccagtggccagcatcatgaagccacagctggggggttgggattcgttttgtctcaggcattgaccttccagaaacaactcagactttactgaaatatcaacatccacatctggagaaagccacacattaattccatgctacccattagtacaagtgtatggattcgtgtattaagtccacaggagactccatggaaggagagattaaagctcttcagagaaggccgatagcgacagaagagtttccaatgcagccagagtgaggttgaggtgccggagcctttccgtggagggatctgtcagaggggatgtgggctgcagaggggaccccacgtaaggaaaggagggtcccaggccctgggtagtgaaaggagaaggtagtcgaggcagtcaagggtgaccctacacgcaggaggcacgccacaccagatcacgccacacgcaggctgctcccaactggcagggcctgacccagccaggaagggccaggtcctaggattccacagtgccaggagtgcccgaaggggccaggtcccaggattcccacagccccaggtgtgcctggaagacccgggtcccaggattcccacagccccagctatgcttgggggggccgagtcccaggattcccacagccccaggtgtgcctggaagacccgggtcccaggattcccacagccccaagagttcccggaagagctgggtcccaggattcccacagccccagctatgcttgggggggccgggtcccaggattcccacagccccaggtgtgcctggaagacccaggtcccaggattcccacagccctggatgtgcctggaggggctgtgccacctctgcagagatggaagggctcgtgttgaagcctgaggatttcgccctcaggtccaggtcagaacatcccagcaccactttcaggccatgtctgccctgcagttttgaccactgaattggtcttaagagtggccacccattcccctccaagtgagggggcaagacacaagtaggggacgggtcactttctgtcaccctgaaaatacgctgggcacgacacaagtaggggatgggtcactttctgtcaccctgaaaatacgctgggcacgacacaaggggggctgatgaagtcaggcccgcccctccaagtccacctcgaaatcaccgtctggcttcctcgcacttcccaccacctgacaccgccaagccccttgcttcagattttctgtggtctgtattcatacccttgcttcagattttctgtagtctatattcatgcctgcttaggcccctacaaaagtcctcataaaaccagcaccacctttatctgcctccaaaacacacactgctttcccatcaggaagatcagcaatgtggtttccggcctggttcttagtcaaaaagttagtgtctggtggtttctggcctttttgcaggacggggcgcagggaacggctgcgcggccaggcagcctccgctgtccacctccagccccggttttgcagccgtgtgtgatatcaagggatagagttagggtttctgtgggttttgtttttgctgaggaaaggatgtgcaggtcgatagctattgtttcctttccattcctgtgattctctttacatctgtatatatctatcacaccatgctgactttgtgatgagtcctgttcctcagaaacatcaagctgggttccttttcaaagaaacacacagatcatatttctccatctcattttgttttcacagggagcttttcttatcaacaaagtcgcatgcttttttttttggatataatgtttatcacgtctggagagccataaacagtaaatacagaggatatcaatgcccagaatagttattttgatgaaatcctatttttagataataaatttcaagatgtgtctatagtgtattgtttaaaacaactgaagacatttgagacgtacataaagtagacatttttaatttagggaaacttatatgcccttttttaagaagccattctaataaaataatctgactaattggcccaaaatacaataagtatcactttctaacagagaccaaagggaagctgagaggctttccttttatgtactaccgttggatcgctgcagccgcctctcataacacccaacagaacccggtgaggctctgtgggcttcccgcggccctcagggaggctgcagagtcccctagtccatgtcagggagccgccatcccacatacctccaaagcctgtcctcgcctgcagtttttgcagagctcgcggttggaggtggaaatttagaagccctgtgttgcaggagaggcagtagcacccccaggcagctcttagcagggacagaccaccccccgcctcgctggtattttagggtcttttggtattttgccactgtgtggggctaggcgggtggctggaggacacggtgtaggccttgccgctgtctgggttcctcgccactgcaggagcagggctgtttctggaaacactgggctgctggtgacccgtcaaacttctcccacaaattctgaatccgagaaagtgaaggaaggatggtggggaagtgaggaggcaggagcagaggccacagggaccaaccagagatgcggtggagacagaggagcttccttctcaggctgtttctgggaagcctgagaggcggccagcaccaccctccgctcactctcccctcagcctcttcgcttcccttctcaaccctttctctcctcctcgcctcttccctttcttgctgtcttgttagtccctgtcccaaaactcctggctcctttgttctgctgccgtggcccccacccaggaggaggtctcaggcaccatccccccacgagggatccacacaacaggttcatgctggggctgggggagccccgctgggttcctgatgccttgtgcacagggagttgctgcagtcatttttggactctcctgaatgtgtccacatgttctgacctcccaccagaaggaacgctggtggccacatctctagagatctatttacttttttgagaccggcttatgagattggctaatttttgtatttttggtagagatggggtctcaccatgttgcccaggctagtctcgaactcctggcctcaagtgatctgcccacctcggcctcccagagtgctgggattacaggcatgagccaccgcgctggcctctagagattcacaccaaacaatatcactcctgcgggaaccgcagacagatcaaaccctggtgagaggaacactttatttcccaactcatcatcctaagccaaggttggagggatgagcattccctaaacaccaaggcgagatcacctggtcccagtgcctcttttcacacaggccctagatttctatctctctgcagtttatgcatcggtaaaaaaaaaaaaatctctcccagtgtgccccgttagttttcagcattttgtaagcaaaatgaacttaacacatagtaattctaattgaaggtatgtacataaaaagcatgatagaatggcaatattgtatcaatggatgtacatttgtaatatttgtaaaaaaaaatccaaaaccttaaaatatgaatttacatgttaatttgcctctaagttctataaattgcacttcagtgatatctaataagtgaatgtttctgttaagtaaataaaaatattcagtaaaa

SEQ ID NO: 105163 - DNA, 1869 bp, Homo sapiens
  Payload ID: 634
  Gene Symbol: ADAT1
  Gene Name: adenosine deaminase, tRNA-specific 1
  Uniprot ID: Q9BUB4
  ENST ID: ENST00000307921
  CDS Start-End: 147-1655
gtgacgtcacgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggcccacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctca

SEQ ID NO: 105164 - DNA, 459 bp, Homo sapiens
  Payload ID: 634
  Gene Symbol: ADAT1
  Gene Name: adenosine deaminase, tRNA-specific 1
  ENST ID: ENST00000568510
  CDS Start-End: 1-57
cagaagctgctaagcagaattgcaagggacaagtggccacactccctcagcttctgatggctcctggcagtccttggcttgtggctgcatcacttcagtttctccctccgtcttcacatggccttctgtgtctgtgtctcgcatggccttcttccctgtgtctgtgtctttccatggcctacttataaggaccccagtaattggatttagggcctgccctaatccagtctgatttcatcttaactaactagatctgcaaagactctatttccaactaaagtcacattctgaggtttcaggtagacatgaagttttgggggacaccactcaacccattgcagaacccattagcagtcacttcccgttcctcaacgccccctaccccagggcaatcagtaatctactttctgtctgtttggatttgtctattctgaacatttcatataaatggaatcatag

SEQ ID NO: 105165 - DNA, 547 bp, Homo sapiens
  Payload ID: 634
  Gene Symbol: ADAT1
  Gene Name: adenosine deaminase, tRNA-specific 1
  ENST ID: ENST00000567281
  CDS Start-End: 66-547
accggcggattaagctcgctttcttctaggcgcgtttcctgaaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgt

SEQ ID NO: 105166 - DNA, 501 bp, Homo sapiens
  Payload ID: 634
  Gene Symbol: ADAT1
  Gene Name: adenosine deaminase, tRNA-specific 1
  ENST ID: ENST00000566450
  CDS Start-End: 1-363
ttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcaggaggccgaggtgggcagatcacgacgtcaggagatcaagaccatcctggccaacatggtgaagcccctttctactaaaaatacaaaaattagccaggtgtattggcgcacgcctatagtcccaactactcaggaggctgaggcagaagaatctctcaaacccaggaggtggaggttgcagtgagccaggatcgtgccac

SEQ ID NO: 105167 - DNA, 582 bp, Homo sapiens
  Payload ID: 634
  Gene Symbol: ADAT1
  Gene Name: adenosine deaminase, tRNA-specific 1
  ENST ID: ENST00000562374
  CDS Start-End: 552-582
cttctaggcgcgtttcctgaaggtgggaggggagcgtccgcgaggcgctggggcgacggggcaggtttatccgggctaactttgccgagtctgtttttgagggaagaggttgtgaggatcgtatcttccgggacgcgtttcacgtgggaaggcgctccacgcctggaactgtcagcagccggcgcctgaagagctcctggcgcggggcctctggcctggcagccgcaggacccaatggatcaggcgctcacgctgttctcactgcatggcttcagtgccttgcctggcacctcctatcctgtaactggccgactcggggtcccacccaggcttctccagcggccgggaaggggctctgcttccggaagtgtttaggaagggagccagcgtaaaccagagtcccttcctccaagcatcgctgaagccttttctcccctggcagccgacttccttttctttggaaaggacgtcgatggccaggtggtcttcataaactatactgccttgtgatgcctccctagaaatgagaggtctcaataccagctcagaccatgtggaccgcggatgagattgctcagctat

SEQ ID NO: 105168 - DNA, 2768 bp, Homo sapiens
  Payload ID: 634
  Gene Symbol: ADAT1
  Gene Name: adenosine deaminase, tRNA-specific 1
  ENST ID: ENST00000566445
  CDS Start-End: 86-397
aggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggaaccagaccctctccagcttccatatgtcttcacctggtgtcctatctttgccgcaggagacatcctcaatgatagccatgctgaggtcatagccagaaggagtttccaaaggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggcccacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgtcagaatgtgtctgctttaccaaaaggcttcggagttcaagaattaaaaatactgcagtcagatttactatttgaacagagccgcagtgcggtgcaggcaaaaagggctgatagcccaggtcgacttgttccttgtggggcagccatcagctggagtgcagttcctgagcagcctttggatgttactgccaatggctttccacagggaacaacaaagaaaacaattggaagccttcaggcaagatcccaaatcagcaaagtggaactcttcagatcattccagaagctgctaagcagaattgcaagggacaagtggccacactccctcagggtgcagaagctggatacctaccaggagtacaaggaggctgcgtcctcttaccaggaagcctggagcacactccggaagcaggtgtttggatcctggatcagaaacccaccggattatcaccagttcaagtgagaaggaaatgtttgctctggtagcaggacccttcatcctgaactgccttcctccacgcaggacaagtcttagcttttttggtagttaaatcagggaacattctttctgagctttgcatctctgttgtgtaatacagatggaatctggaacttagagcaagctatacttgattgaagtagctctctgctaaaatggcatctcactaatgacctcactatctgacttccattgtgttttattgcttctctaaaatatgaaatcagagtttggaacatgatgctttgaaagtactctgcagcagctctgttttatgggttcctacattgattcagcaaatatttattgagctgaaatgatgtttgacgctctgcaagttttacagctttgcctagcatagcgaatatatattttgtattcccagcctttctttcttcagggagccattcttttcccattcttcagtgatcctgctctgtgcctcagacttggctgaagctaaccttactccctggctctaggaatagcctgtgagccagccctggactgccctggacttgttctcagaggtatcaggaaaggctttctgttttgatctggagctgtaagggtcacataatcatgggactgccggtggccatcttttcctactacctagagaaagccagcaaagaatgaaggcaacaaaggaaacagccaagagaatcaaagatctagtaacactgtttagatgtctcaattatgtgagacagattcctgttgttattttgattaagcctgtttgtgttggttttctgacttacaattgaaagagttctgtccaaaaagccaaaaggtggccaggcttggtggctcaggcctgtaatcccagcactttgggaagcccaggcaggcagatcacttgaggtcaggagttcaagaccagcctggccaacctggtgaaaccctgtctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctc

SEQ ID NO: 105169 - DNA, 731 bp, Homo sapiens
  Payload ID: 634
  Gene Symbol: ADAT1
  Gene Name: adenosine deaminase, tRNA-specific 1
  ENST ID: ENST00000564657
  CDS Start-End: 403-731
ttttagcttgttgaaactgttcagagatgcggtcttgtgggcaaataaatgcctgtttagctgagctgttattttcagctaagaagttcttcaagttttcaagatctaggagggggtgtaggctcgaattataatggacccagtgtagcaaaacatttattcatttaaacaattgtgcatgctcattcagacgcactacctgagtgagatgatgccgttctgggctgcttcatcttaaagagagtcactgtttcttctggcaacttctacctgccttgcctatcgaggtttgtgaattgcacctctggtttaatttcaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggagacatcctcaatgatagccatgctgaggtcatagccagaaggagtttccaaaggtaccttctccaccaactccagttggcagccaccct

SEQ ID NO: 105170 - DNA, 570 bp, Homo sapiens
  Payload ID: 634
  Gene Symbol: ADAT1
  Gene Name: adenosine deaminase, tRNA-specific 1
  ENST ID: ENST00000568001
  CDS Start-End: 128-403
accggcggattaagctcgctttcttctaggcgcgtttcctgaaggtcgatggccaggtggtcttcataaactatactgccttgtgatgcctccctagaaatgagaggtctcaataccagctcagaccatgtggaccgcggatgagattgctcagctatgctatgaacactatgggatcaggctgcccaagaaggggaagcctgagccaaaccatgagtggacattattggcagcggtggtgaagatacaatctccagctgacaaggcctgcgacacccctgataagccggtgcaagtgacaaaggaagttgtgtcaatgggaacaggaacaaaatgcataggacagtccaaaatgaggaagaacggtaccttctccaccaactccagttggcagccaccctgaaagaggatagcatctttgtcccaggaactcaaaaaggagtgtggaaacttagacgagacctcatttttgtgtttttctccagccatacaccctgtggggatgcctccatcattccgatgcttgagtttgaagatcagccttgctgtcctgtcttcagaaattgggcc

SEQ ID NO: 105171 - DNA, 2065 bp, Homo sapiens
  Payload ID: 635
  Gene Symbol: ADAT2
  Gene Name: adenosine deaminase, tRNA-specific 2
  Uniprot ID: Q7Z6V5
  ENST ID: ENST00000237283
  CDS Start-End: 16-591
gagtggtggctgggtatggaggcgaaggcggcacccaagccagctgcaagcggcgcgtgctcggtgtcggcagaggagaccgaaaagtggatggaggaggcgatgcacatggccaaagaagccctcgaaaatactgaagttcctgttggctgtcttatggtctacaacaatgaagttgtagggaaggggagaaatgaagttaaccaaaccaaaaatgctactcgacatgcagaaatggtggccatcgatcaggtcctcgattggtgtcgtcaaagtggcaagagtccctctgaagtatttgaacacactgtgttgtatgtcactgtggagccgtgcattatgtgtgcagctgctctccgcctgatgaaaatcccgctggttgtatatggctgtcagaatgaacgatttggtggttgtggctctgttctaaatattgcctctgctgacctaccaaacactgggagaccatttcagtgtatccctggatatcgggctgaggaagcagtggaaatgttaaagaccttctacaaacaagaaaatccaaatgcaccaaaatcgaaagttcggaaaaaggaatgtcagaaatcttgaacatgttctgatgaaagaaccaagtgacccaaagtgacctggacaagattcatagactgaaagctgttgacatcgttgaatcatatgtttatatattgtttttaatctgcaggaaaatggtgtctctcatcatttgctctgttaagggaacaaattagcactttttagaagtctgacaattgtaaacagttattagcttttccagaagctgattcccattttaagatgggggaaaattaaggtttgaggttttagaaattagcaagtagtgcatacccttctagccacaagtgcccagtccaggcaagtgctgacttcttagagaatgtgtggccagacccagggacctggagtgtgtttggactgcagtttgccaccctgagaacaccttctccaggactggcatttcagaatcagattcttcattttttgcagctacgatgttcttccagggcactgggggctgtgacttctctctaaattgtatataagttgtgtatatagagaccataattatatggtccttagaaaagactttgcttttataaagcatttagaaaaaatgcatacttttaaaacaagtgcttgagttgtcacttaaaaattatagcatattgctataataaaaccttatttatgtcttatttgaagatgaatagtcttaaaagataaagacataaatgggacaattgttattgagcaaaaaaccaaattatcccaccctcatggagcttatattctagcaaggggagatggatatgatagattacacagtttattggaggacaataagagttatggcaaaaagcaaaaggaacacagggtaaaggggataggtgccatttggtggtgagaatgctgactgaaaaatagaatgatcaatttaatctgaaacaaatggttatttcttttataatccatataataaatttaaaatctaaaatgtaaaattttgaacacaacactggaaagggtatccacagcaggaagtccccagttcacctccatgactacagggcagctttgcacagccctctgggcgcactgtgtgcctctgcccagaagggggcctcgccgttccaccagaagctcagctccaggccctggaggggctgctgctcctcagttgcatttcttcagtagattcatttccttgatgcaaagcatctgtatttgttggttctgtcatttgagcgatgtctctgacttgtttgttttgaattacattacaggctggaatgtaattgtggtgaaagtatttttatattgctgagagtagcagctaatcacagttacatgcttcagaggacttataattgcttggttttgtgtgtgtgtgtgtgtgtgtgtgtgtgtgtgtgtgtgtttaactgcatttgaaaagttttatggagaatatgcatgattttaaatctgtgataatgttacatgcaccttcaatttcatccactttaaaaattatcttctcattgaa

SEQ ID NO: 105172 - DNA, 6651 bp, Homo sapiens
  Payload ID: 635
  Gene Symbol: ADAT2
  Gene Name: adenosine deaminase, tRNA-specific 2
  Uniprot ID: Q7Z6V5
  ENST ID: ENST00000606514
  CDS Start-End: 586-1020
agtgtggctgtaccattttatattccgaccagcagtatatgagtaatatcacttctccacagccttgccagcatttgatgttgtttttacgtttcactttagtcatgctgatgggtgtgtagtgatacctcattgtggttttagttgacatttctctaccggctaatgatgtgaaaacatcttttcgtgtacttatttgctatgtgtgttatcttctttggtgaaatgtctgtcttttgccttctcatatagtttggatatttgtcgcctccaaatttcatgttgaaattgaatccctggtattagtagcagggcctggtgggaagtttggatcatggggaggatacctcataaatcatttttatagtggcaagttctcactatattattatcatgagaatataccatcccctcctttctttcttcttctcttaccatgtgatgcctgctcccattgccttctgccatgagtggaagcttcctgaggccctcactggaagcagatgctgataccatacttcttgtacagtctggagaactgccaaagaagccctcgaaaatactgaagttcctgttggctgtcttatggtctacaacaatgaagttgtagggaaggggagaaatgaagttaaccaaaccaaaaatgctactcgacatgcagaaatggtggccatcgatcaggtcctcgattggtgtcgtcaaagtggcaagagtccctctgaagtatttgaacacactgtgttgtatgtcactgtggagccgtgcattatgtgtgcagctgctctccgcctgatgaaaatcccgctggttgtatatggctgtcagaatgaacgatttggtggttgtggctctgttctaaatattgcctctgctgacctaccaaacactgggagaccatttcagtgtatccctggatatcgggctgaggaagcagtggaaatgttaaagaccttctacaaacaagaaaatccaaatgcaccaaaatcgaaagttcggaaaaaggaatgtcagaaatcttgaacatgttctgatgaaagaaccaagtgacccaaagtgacctggacaagattcatagactgaaagctgttgacatcgttgaatcatatgtttatatattgtttttaatctgcaggaaaatggtgtctctcatcatttgctctgttaagggaacaaattagcactttttagaagtctgacaattgtaaacagttattagcttttccagaagctgattcccattttaagatgggggaaaattaaggtttgaggttttagaaattagcaagtagtgcatacccttctagccacaagtgcccagtccaggcaagtgctgacttcttagagaatgtgtggccagacccagggacctggagtgtgtttggactgcagtttgccaccctgagaacaccttctccaggactggcatttcagaatcagattcttcattttttgcagctacgatgttcttccagggcactgggggctgtgacttctctctaaattgtatataagttgtgtatatagagaccataattatatggtccttagaaaagactttgcttttataaagcatttagaaaaaatgcatacttttaaaacaagtgcttgagttgtcacttaaaaattatagcatattgctataataaaaccttatttatgtcttatttgaagatgaatagtcttaaaagataaagacataaatgggacaattgttattgagcaaaaaaccaaattatcccaccctcatggagcttatattctagcaaggggagatggatatgatagattacacagtttattggaggacaataagagttatggcaaaaagcaaaaggaacacagggtaaaggggataggtgccatttggtggtgagaatgctgactgaaaaatagaatgatcaatttaatctgaaacaaatggttatttcttttataatccatataataaatttaaaatctaaaatgtaaaattttgaacacaacactggaaagggtatccacagcaggaagtccccagttcacctccatgactacagggcagctttgcacagccctctgggcgcactgtgtgcctctgcccagaagggggcctcgccgttccaccagaagctcagctccaggccctggaggggctgctgctcctcagttgcatttcttcagtagattcatttccttgatgcaaagcatctgtatttgttggttctgtcatttgagcgatgtctctgacttgtttgttttgaattacattacaggctggaatgtaattgtggtgaaagtatttttatattgctgagagtagcagctaatcacagttacatgcttcagaggacttataattgcttggttttgtgtgtgtgtgtgtgtgtgtgtgtgtgtgtgtgtgtgtttaactgcatttgaaaagttttatggagaatatgcatgattttaaatctgtgataatgttacatgcaccttcaatttcatccactttaaaaattatcttctcattgaattttagtgcttctactagtttgttcctttttgcagttggtcgtaattcatttctggcttcttatgctttcctgcaagcagatttcattgcatttattgtgttcatatcattttcttggggattatttgtaggacaaccaacctggagttttgcctctctagagtaccacccagtaagtctggctgagcatcttatgtccagtaggttcttggtaaacatttgctaaatgaaattactgattgaaatttggggaaaagtgaataagaagactatctaggacaaaaagccaaagccgaaaatagtatatgagcattctagcccagagactgtcgctactaaaagaatgaaggaaataataaagtgatagacagggaaggatagaaaagacttaacaatatacatatgttccgtctttgctgttttggagaatgatggataagtagtgtttcctgattctgaagcatagctgaacaatttaattgtggtttaccatctttttggttccctcttcagtaattaacctatcgaaaatctgtcctaaatgtttggactggggcacagttccctccatcgctttgggagaaaatcattaatatggcatactgcagattggagggcaggaccactgagggtgtcatagacattagctctatggaattctgctagcaatttccaagtgacagtgaggaattatggatatatgttgaggtcattcagcttcctgagtaccacattccccagctacttagacacgggttaaaatattaagatgtcctagttcaacagcttgaattccattgattgatactgatagtgcctgtccaagacaccagctgaaagacttgttttgtgtacaaaatagttctgaaagtggtgagatacaaaaaggttttagaatcactgccctgttgagagaaattagggggaaatgattacatttagaagctgctagagttatccagtgtttgctggtctttgcaacaaactgtggagaatgggtggtatgtaatgctttggtaggcttcaatcactgataaaagatcatgttaaaatatctttgtgctttcttgttacttggcacaaccatctcttcctgtgttgtatttggagtatcatggagagaaaatagatggccaagagcttcagtgtaggcaagaactcttaatttttctttaaactttttactgggaaaagtatatatatataaaatacacacacacacacacacacacacacacacacacacacacacacaaacacaacacaccatggccctttaccccgaaatgcttcagtatagttattgacttaagtaaatttaacattgatatacttgaatctatcatttgtattacagttttgtcagctgacccaataatgtcctgtaaagaagttctcccactaccctataatcccaggtccagtctagggtccagcattacatttacttgtcttgaatccagctttttcttttttttttttttttttgagataggtctcactctgtcgtccagtggcatgatcacagctcactgcagcctcaacctggctcaagcaatccttcctcctcagcctcctgagtagctgggaccacagactcatgtcaccacacctaatttttttttttttttttttttgtagagacaaggtctcactatgttgcccaggctggtcttgaactcctaggctgaagcaatcctccttccttggcctcccaaagcactgggattatagacgtgagccactgcaccggtctgcctttagcttcttttagtctagaacattttcactggctttctttgtcttttatgacattgacatttttaaataatacagtcattttgcctcctttctgttttcttcttctttttttaaataatagaatggtccttgttttaaatttatttgatattttcttgtgattagattcaggtgctggttgatgttaagttcctcacaggatatcacatctggaggcacacaaaggccgtcacaccaaggtgatgtcaattttggtcatctggtcaaggtgttgtcctattccttcactatatagttaccttttttctctgttgcaatgaataagcagtctgtgggaagaggagctgttacattttaaacagaaaatgtatttgacactgatggaaaggagaggaggaaaattaatgacataaatttcaaagcaactattaaattatttgattgcattcttcctcttttactgtctgccaaaattgataaaaaaaatttttctaataagaatgttttaaatagtgatatcttaataagcatcaaaattaagcctgagaaataaattctttccttcctaatttcctcctcagcaaaagtaataattatataaatttcattatgcctgataagatagggttttggaaaatagacctaagatgtttctgatactgcagatgacctatggtgatccaatgggataaacactctaggtaggttgtcatttggtcataaaatatgagttatcttgggtttccatagagacatctagacttaaaatgttgtaagcactgctactttcaaaatgtcagtaaaaatagcaaaagccaaagctcttgaaaaaattacttaaatcttttttaaaagtagtatagcgccttgttaaaaatctgtggtgatgccaaagcttgtctttcccagtggtcctacgtgaactggccttatagccccagggaaaccagacaccaggaattggtttctctgccttttggcaaaggaataagactacattgacttcatctatgaagacaactgccaactatttcctttgtaaattgctaattttgtgtagtgaggaaaggagcgatgggcgacgtgatttttatggattagactggtgagttctgctgaaagtttgacatctttaggatcttacattttcttcaagttgagctaatgaaaacaggctcgtgactatttatcacctgatttctaagtggatattgggttgaacaccacatatccatgactattaaggaggcttcatggtgtagtttgacaaaggctctctccttgaccaaacttcagtcaggccctaagtcctctttttaaccaggcctccaccttggcccccattcttgatgggcctatacagcccagctttagcaagaatcctgctaagctagtttagagagaatcccacatccccaatatctatgaaatttctcatcccctacttttgatgtgtaagtccttggcctcccttcaacgagaagcctgttaagttcattttgcaagaactctactcttgatatctcctcttagtaatttcctaatcactgaccccctcactctgcccattagttataaacccccacatgttctggttgtattcagagctgagcctgatctcttcctcttgttgggatagttttaaaacctgcgatagttttaaaacctatcactgtagtcctgaattaagtcttccttaccttaacaagtgtcaaaataaatttttctttaacatgttgaagcatgaacttgagaatctagagcaggagtccacaaagtatggcccatgggccatatccagcccgctgccggtttcggtaccactcatgacttaaaaatgggtcttacaattctgagtgattgaaaaaaaatcaaaagaaggataatatttagtgacccatgaaccttatatggcaatcaaatttcagtgtccataaataaagttacattggatgacagccatgcccatttgtttctgtgttgtctgtggctgctcgtgtgctacaatggcagagttgagcagtggtgacaaaccatgcgactcacaaaggcctaaaatatttagcgtctggcccttcgagaaaatgttagctgcccctggtctagagtaggtaaaaggctgagattggaagctgcttgttcaaattctgtgattggaaccgaatgatgtggctcattgtacagctcatggtgaattgcttcagtaccatggttttgttttttccttttgaaaagttggtctataaatgtaaaggaaaaatctaagataccaaaatatgttttctggcttagaatgttttatttccttgtatacattttaagagagtggcaaggagaaaagataatgtatcattttatttgggtttagaataaataatacattttatttatgatca

SEQ ID NO: 105173 - DNA, 1620 bp, Homo sapiens
  Payload ID: 636
  Gene Symbol: ADAT3
  Gene Name: adenosine deaminase, tRNA-specific 3
  ENST ID: ENST00000329478
  CDS Start-End: 221-1324
ggttgggccgggccggttgctaagacttggcgaagcgctgcgctcgcgcccggatccctcaggggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggacccccgcggcctggggcaacccttcctggtgcccgtgcccgcccggccgcctctgaccaggggccagttcgaggaggcccgggcccactggcccacgtccttccacgaggacaagcaggtgaccagcgccctggctgggcggctcttctccacgcaggagcgcgccgccatgcagagccacatggagcgggcggtgtgggcggcccggcgggcagcagcgcggggcttgcgggccgtgggggccgtggtagtggacccggcctcggaccgcgtgctggccaccggccacgactgcagctgcgcggacaaccccctcctgcacgccgtcatggtgtgcgtggacctcgtggcgcgcggccagggccgcggcacctacgacttcagacccttccccgcctgctccttcgccccggccgctgccccccaggccgtccgcgcaggcgccgtgcgtaaactggacgcagacgaggacggcctcccctacctgtgcactggctacgacctgtacgtgacccgcgagccctgcgccatgtgcgccatggccctggtgcacgcacgcatcctgcgcgtcttctacggtgcgccctcgcccgacggcgccctgggcacccgcttccgcatccacgcacggcccgacctcaaccaccgcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaaccaa

SEQ ID NO: 105174 - DNA, 983 bp, Homo sapiens
  Payload ID: 636
  Gene Symbol: ADAT3
  Gene Name: adenosine deaminase, tRNA-specific 3
  ENST ID: ENST00000454697
  CDS Start-End: 776-983
tttgtttttcatcagacagaggttgtactcttggagggacaagcgaggctgtgtttgtcttttaccctggagacagtggagtgtttgtggcctagcagggccgtgcgggcctctcggtcctggtcgcgcgtggtgtgcgttttgggagggcccagcgagtcggctgctatgggccccacctggcacggggcctcgggcagcggcagcacctggcgctgcctccgcgcttcctgctcccggctcccactgcatctccggttctgtgctttgttgaacgcgtgagcttcgggcagcgctggggccgcttcagcgtgacctccaaggccactggcctggagttccactggctgctggtcccccatctgtggggcgccccggcggctgaggcgtggaccaggcagtgcatgtcgaggagtagcacccacagctgcgcggctgcgaaatgatccagagacacatccctgtctgcgggaggagccgtccataccagcggggatgtgtagtccaggctggcagttcaggatcacccggctggagtcattttaagatcatctgcggcttagccccagcaccatctgaggcagtactgtctgctagaaataactgtgagcacacaggggttagcaggacatgagggagtgtagctctgatgcggtgacctgggccggagccctcggactagcctcagctttggtggcagcacgccctgccttgtggagccacggcctcccgggacggactccccggctctcccccagccgcccgcagccgccggatgatcctctgctcccgtctctgtctcccacagtcggcctcgctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagc

SEQ ID NO: 105175 - DNA, 1559 bp, Homo sapiens
  Payload ID: 637
  Gene Symbol: ADAL
  Gene Name: adenosine deaminase-like
  Uniprot ID: Q6DHV7
  ENST ID: ENST00000389651
  CDS Start-End: 421-1224
catttgtcccagaatacggtccgctaccgctgtgacatgagtgttagggaaggcgggttgtcacgtttctacaagccttccagtcaaaagggaaaccttgcctaagtccttgtagttgagaaatctctaagaggaggctgaagtgggaggatcgcttgagtctggaagcttgagactgcagcaagctgtgatcgtgacactgcactccagcctgggcaacaaagtaagatcctgtctcaaaagaaaaaaaaaaaaaggtgaagctgaacccagatctacacatacagctaatcttaccaaaatgtgtggaagtaaagcaatctgaaggaaattcagtaccatacaatttactgactgaaatacatcatattgctcatactaagaataagagtggagaagaatcatttttttcctgctaaaatgatagaggcagaagagcaacagccttgcaagacagacttctattctgaattgccaaaagtggaacttcatgcccacttgaatggatccattagttctcataccatgaagaaattaatagcccagaagccagatcttaaaatccacgatcagatgactgtgattgacaagggaaagaaaagaactttggaagaatgtttccagatgtttcaaactattcatcagcttactagtagccctgaagatattctaatggtcacaaaagatgtcataaaagaatttgcagatgacggcgtcaagtacctggaactaaggagcacacccagaagagaaaatgctactggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactgggtaaggcttggagtttcaggtcttccagatgactctctgtctctcccccaatccccaggttgcctggggattacagagaagtactgttctaaaagtacgaatgtcatctagctattaaaagatggagtgtgtgctttctgagccttatttaaaacagaaagctttagcttccattagaatataagctctatgagagcagggcccctgcttgtcttattcgttgttacattctccaatgcttggaactcaataagaattttttaaaggaataaagggtcatctagaattttaaaatgactttaacaaaattgacatgtgttatgaaaatatgtaacattatttaaaaattaaacatggaaaatcccaa

SEQ ID NO: 105176 - DNA, 3767 bp, Homo sapiens
  Payload ID: 637
  Gene Symbol: ADAL
  Gene Name: adenosine deaminase-like
  Uniprot ID: Q6DHV7
  ENST ID: ENST00000422466
  CDS Start-End: 171-1157
aaaataggtgaagctgaacccagatctacacatacagctaatcttaccaaaatgtgtggaagtaaagcaatctgaaggaaattcagtaccatacaatttactgactgaaatacatcatattgctcatactaagaataagagtggagaagaatcatttttttcctgctaaaatgatagaggcagaagagcaacagccttgcaagacagacttctattctgaattgccaaaagtggaacttcatgcccacttgaatggatccattagttctcataccatgaagaaattaatagcccagaagccagatcttaaaatccacgatcagatgactgtgattgacaagggaaagaaaagaactttggaagaatgtttccagatgtttcaaactattcatcagcttactagtagccctgaagatattctaatggtcacaaaagatgtcataaaagaatttgcagatgacggcgtcaagtacctggaactaaggagcacacccagaagagaaaatgctactggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctggtacagcattgcccatccttctgtgatctgtactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtactagaaagtgaagtcattgctccaattttggaagaggagagaataactggctgaggggtgagaaagacagaaatagctgcagctctcttttttttttttttcaacaaaggctctcactctgttccccaggctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaattattagataccaagttatgcttgaattgctttgctctttagaatgtgtgtttttccctggtatcagaagaagttaaggctgatgacacccctaatttaaattactaaggatttctgataggttttctgtctttctgtgatatcgtaaagtatttatttggtctttgaccctgtttcctggcatactgctcctaaaatccttagagtctccagagtgatggctttttgtatctaatgagttgactgctggctggcagcccctaggggctggtcactggaaagacaaatgcatgattagagttgggactttcagtcctcccccaaactcttgggagaagggctgaaggttaagttgatcaccagtgaccagtggtaatcataccttcataatgaagcctccataaaactccagaagaacagattttggagcatttccaggtaactgaacatatggaggtccctagagggtgctgtacctgaagagggtagagggtataggagctccctgtcccttcccacatgccttgctctatccatttcttcatctctatcctttgtactgtcctttataataaaccagtgaacctaagtgtttccctgagttctgtgagctttactagcaaattaaactcaaggaggggtcatgggaaccctgatttataggtttggtcagaagcacaggtaaaaccacctggggtttgaacttggcactggaagtgggcagcagtcttgtgggactgggccctcaatctgtgggatcaaatgccatctctaggggatagcatgggaaactggaggacacctagctggtatctgctgcaaaattgattgcttgcttgatggtggggaaaaaactccacacatttggtcagagaagttttctgtctttattgtggtgtgagagcagaggaaaaaagtttgttttttccgctcagactttgttttaaggaacaggggagagggaagttctgtggtttttgaagttcttagatacgtgtgtgtagctttgtgtggcattatatatagcattatattattttctacccttatctactcatacagaaattgcacagtaaaaacatcaaagtttattcataaaatgtggatctattgcagtcactaaaaatgttgcagaacagattttaatgactgaaagtgttcatgataatatattcaatgaaaatatggttataaagttttatagtcctttttttgtttaatatctatacaaaagctattgaagtgt

SEQ ID NO: 105177 - DNA, 3514 bp, Homo sapiens
  Payload ID: 637
  Gene Symbol: ADAL
  Gene Name: adenosine deaminase-like
  Uniprot ID: Q6DHV7
  ENST ID: ENST00000428046
  CDS Start-End: 575-1561
agccagtgctaagttcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggtggaagcaaatactgcacatgcgtgttggtcctgtgagggaaaccagctagtggagagggagaggttgaaggaacagaaaaatgagaagacaactcactggaggctgaagtgggaggatcgcttgagtctggaagcttgagactgcagcaagctgtgatcgtgacactgcactccagcctgggcaacaaagtaagatcctgtctcaaaagaaaaaaaaaaaaaggtgaagctgaacccagatctacacatacagctaatcttaccaaaatgtgtggaagtaaagcaatctgaaggaaattcagtaccatacaatttactgactgaaatacatcatattgctcatactaagaataagagtggagaagaatcatttttttcctgctaaaatgatagaggcagaagagcaacagccttgcaagacagacttctattctgaattgccaaaagtggaacttcatgcccacttgaatggatccattagttctcataccatgaagaaattaatagcccagaagccagatcttaaaatccacgatcagatgactgtgattgacaagggaaagaaaagaactttggaagaatgtttccagatgtttcaaactattcatcagcttactagtagccctgaagatattctaatggtcacaaaagatgtcataaaagaatttgcagatgacggcgtcaagtacctggaactaaggagcacacccagaagagaaaatgctactggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctggtacagcattgcccatccttctgtgatctgtactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtactagaaagtgaagtcattgctccaattttggaagaggagagaataactggctgaggggtgagaaagacagaaatagctgcagctctcttttttttttttttcaacaaaggctctcactctgttccccaggctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaattattagataccaagttatgcttgaattgctttgctctttagaatgtgtgtttttccctggtatcagaagaagttaaggctgatgacacccctaatttaaattactaaggatttctgataggttttctgtctttctgtgatatcgtaaagtatttatttggtctttgaccctgtttcctggcatactgctcctaaaatccttagagtctccagagtgatggctttttgtatctaatgagttgactgctggctggcagcccctaggggctggtcactggaaagacaaatgcatgattagagttgggactttcagtcctcccccaaactcttgggagaagggctgaaggttaagttgatcaccagtgaccagtggtaatcataccttcataatgaagcctccataaaactccagaagaacagattttggagcatttccaggtaactgaacatatggaggtccctagagggtgctgtacctgaagagggtagagggtataggagctccctgtcccttcccacatgccttgctctatccatttcttcatctctatcctttgtactgtcctttataataaaccagtgaacctaa

SEQ ID NO: 105178 - DNA, 475 bp, Homo sapiens
  Payload ID: 637
  Gene Symbol: ADAL
  Gene Name: adenosine deaminase-like
  ENST ID: ENST00000563551
  CDS Start-End: 193-300
cagaaaaatgagaagacaactcactggaggctgaagtgggaggatcgcttgagtctggaagcttgagactgcagcaagctgtgatcgtgacactgcactccagcctgggcaacaaagtaagatcctgtctcaaaagaaaaaaaaaaaaaggaacttcatgcccacttgaatggatccattagttctcataccatgaagaaattaatagcccagaagccagatcttaaaatccacgatcagatgactgtgattgacaagggaaagaaaagaactttggaagagtcacaaaagatgtcataaaagaatttgcagatgacggcgtcaagtacctggaactaaggagcacacccagaagagaaaatgctactggaatgactaaaaagacttatgtggaatctatacttgaaggtataaaacagtccaaacaagaaaacttggacattgatgttaggtatttgatagcagttgacagaag

SEQ ID NO: 105179 - DNA, 1228 bp, Homo sapiens
  Payload ID: 637
  Gene Symbol: ADAL
  Gene Name: adenosine deaminase-like
  Uniprot ID: Q6DHV7
  ENST ID: ENST00000562188
  CDS Start-End: 17-1084
tttttttcctgctaaaatgatagaggcagaagagcaacagccttgcaagacagacttctattctgaattgccaaaagtggaacttcatgcccacttgaatggatccattagttctcataccatgaagaaattaatagcccagaagccagatcttaaaatccacgatcagatgactgtgattgacaagggaaagaaaagaactttggaagaatgtttccagatgtttcaaactattcatcagcttactagtagccctgaagatattctaatggtcacaaaagatgtcataaaagaatttgcagatgacggcgtcaagtacctggaactaaggagcacacccagaagagaaaatgctactggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctggtacagcattgcccatccttctgtgatctgtactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggt

SEQ ID NO: 105180 - DNA, 2582 bp, Homo sapiens
  Payload ID: 637
  Gene Symbol: ADAL
  Gene Name: adenosine deaminase-like
  ENST ID: ENST00000566154
  CDS Start-End: 1-332
taaaacttgccgaggagttcttcctttctactgagggtacagttcttggccttgacctcagtggagaccctactattccaaaccaaaaaaaagaaacacaaatactcctggatctgcttcctgacagaatcgggcatggaacatttctcaactccggtgagggaggatccctggatctggtggactttgtgaggcaacatcggataccactggaactctgtttgacctcaaacgtcaaaagtcagacagttccatcttatgaccagcaccatttcggattctggtacagcattgcccatccttctgtgatctgtgtaaggtgttccgtgtgaagtattttgctcctttttgctccctgagttgcattaattcagatgttcactatctagctgactgccttgcatgcctgaggataatgcccaagtagaggagttagaagggaccggggtgtggctgagtatggtggcgcacacctgtaatcccagctactcgggagactaaggcaggagaatcacttgaacccaggaggaggaggttgcagtgagcagagatcatgccattgcactccatcttgggcaacaagagtgaaactccatctcacaaagcaaaaaaaaaaagggactgggacatgagaggctacagagggccagggtgactctggtttggctctctagcaaaaggtacttgagaggacttaaaaacaaacaaaaaaactgatgctctgcacccatcccatgagattctgttttatttgatctggggtgagtcctgggcagagataggctttaaaagctccttaggtaattttaatatccagccagagttgaaacactgctctggtatcttttcttaagtataaataaatctgtttagttacagctatgcatagataaatttgtaggcccttgtttagactcttgaaagaagcatagtaaataggaaaatagactctaaacaaaaagatggttgtttttgaaaaatccttcctttttcattttgaaacattcttgtttacgttggcagactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtactagaaagtgaagtcattgctccaattttggaagaggagagaataactggctgaggggtgagaaagacagaaatagctgcagctctcttttttttttttttcaacaaaggctctcactctgttccccaggctggagtgcagtgacatgatcacagatcactgcagctttcagttttaaaacagcttttattacattttctttgtggaagctgtatttctaccttagtactcactttctgcttggtctgaaagatacctctagtagtggcaacattgtgttaagtagagttcattgggtctcttgtaaccctacccctacataatggaccactggtgcaggcttacataaacacacatactgtggccacttcagctgaagacaagggacaaactaagatagttctgaaaggtaaaaaaacaaacaaacaaacaaaaaacaaaaacaaaa

SEQ ID NO: 105181 - DNA, 974 bp, Homo sapiens
  Payload ID: 637
  Gene Symbol: ADAL
  Gene Name: adenosine deaminase-like
  Uniprot ID: Q6DHV7
  ENST ID: ENST00000610420
  CDS Start-End: 171-974
aaaataggtgaagctgaacccagatctacacatacagctaatcttaccaaaatgtgtggaagtaaagcaatctgaaggaaattcagtaccatacaatttactgactgaaatacatcatattgctcatactaagaataagagtggagaagaatcatttttttcctgctaaaatgatagaggcagaagagcaacagccttgcaagacagacttctattctgaattgccaaaagtggaacttcatgcccacttgaatggatccattagttctcataccatgaagaaattaatagcccagaagccagatcttaaaatccacgatcagatgactgtgattgacaagggaaagaaaagaactttggaagaatgtttccagatgtttcaaactattcatcagcttactagtagccctgaagatattctaatggtcacaaaagatgtcataaaagaatttgcagatgacggcgtcaagtacctggaactaaggagcacacccagaagagaaaatgctactggaatgactaaaaagacttatgtggaatctatacttgaaggtataaaacagtccaaacaagaaaacttggacattgatgttaggtatttgatagcagttgacagaagaggtggccctttagtagccaaggagactgtaaaacttgccgaggagttcttcctttctactgagggtacagttcttggccttgacctcagtggagaccctactgtaggacaagcaaaagacttcttggaacctcttttagaagctaagaaagcaggtctgaagttagcattgcatctttcagagattccaaaccaaaaaaaagaaacacaaatactcctggatctgcttcctgacagaatcgggcatggaacatttctcaactccggtgagggaggatccctggatctggtggactttgtgaggcaacatcggataccactgggtaaggcttggagtttcaggtcttccagatga

SEQ ID NO: 105182 - DNA, 1169 bp, Homo sapiens
  Payload ID: 638
  Gene Symbol: ADK
  Gene Name: adenosine kinase
  Uniprot ID: P55263
  ENST ID: ENST00000286621
  CDS Start-End: 51-1139
gtggatggcagaggtgggctgtagagccaaagtggggtgggagcgcgaagatggcagctgctgaggaggagccgaagcccaaaaagctgaaggtggaggcgccgcaagcgctgagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagt

SEQ ID NO: 105183 - DNA, 2083 bp, Homo sapiens
  Payload ID: 638
  Gene Symbol: ADK
  Gene Name: adenosine kinase
  Uniprot ID: P55263
  ENST ID: ENST00000372734
  CDS Start-End: 188-1225
cgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataa

SEQ ID NO: 105184 - DNA, 2222 bp, Homo sapiens
  Payload ID: 638
  Gene Symbol: ADK
  Gene Name: adenosine kinase
  Uniprot ID: P55263
  ENST ID: ENST00000541550
  CDS Start-End: 385-1368
cggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcagagaaaatattctctttggaatgggaaatcctctgcttgacatctctgctgtagtggacaaagatttccttgataagtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcaggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggt

SEQ ID NO: 105185 - DNA, 1866 bp, Homo sapiens
  Payload ID: 638
  Gene Symbol: ADK
  Gene Name: adenosine kinase
  Uniprot ID: P55263
  ENST ID: ENST00000539909
  CDS Start-End: 95-1012
ggagaagagaaagcggtgatgcgaagagggggcgggaccagagagtggatggcagaggtgggctgtagagccaaagtggggtgggagcgcgaagatggcagctgctgaggaggagccgaagcccaaaaagctgaaggtggaggcgccgcaagcgctgagagaaaatattctctttggaatgggaaatcctctgcttgacatctctgctgtagtggacaaagatttccttgataagtattctctgaaaccaaatgaccaaatcttggctgaagacaaacacaaggaactgtttgatgaacttgtgaaaaaattcaaagtcgaatatcatgctggtggctctacccagaattcaattaaagtggctcagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtccctcatagctaatcttgctgctgccaattgttataaaaaggaaaaacatcttgatctggagaaaaactggatgttggtagaaaaagcaagagtttgttatatagcagaagctgccacttttgctagagagcaaggctttgagactaaagacattaaagagatagccaaaaagacacaagccctgccaaagatgaactcaaagaggcagcgaatcgtgatcttcacccaagggagagatgacactataatggctacagaaagtgaagtcactgcttttgctgtcttggatcaagaccagaaagaaattattgataccaatggagctggagatgcatttgttggaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggt

SEQ ID NO: 105186 - DNA, 2392 bp, Homo sapiens
  Payload ID: 639
  Gene Symbol: AMPD1
  Gene Name: adenosine monophosphate deaminase 1
  Uniprot ID: P23109
  ENST ID: ENST00000369538
  CDS Start-End: 49-2379
acttagcagagaagaatcaaatttccgggggcaaagcaaaataataaaatgaatgtcaggatattttatagtgtcagtcagtcaccccacagtctcctctctcttcttttctactgtgctatcctagaatcaaggatttcagcaacaatgcctctgttcaaactcccagaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaacc

SEQ ID NO: 105187 - DNA, 2375 bp, Homo sapiens
  Payload ID: 639
  Gene Symbol: AMPD1
  Gene Name: adenosine monophosphate deaminase 1
  Uniprot ID: P23109
  ENST ID: ENST00000520113
  CDS Start-End: 17-2359
aaagcaaaataataaaatgaatgtcaggatattttatagtgtcagtcagtcaccccacagtctcctctctcttcttttctactgtgctatcctagaatcaaggatttcagcaacaatgcctctgttcaaactcccagctgaagagaaacaaattgatgatgcaatgcgcaactttgctgaaaaagtgtttgcctctgaagtcaaagatgaaggaggtcgtcaggagatttccccctttgatgtggatgagatctgtccgatttctcatcatgagatgcaagcacacatattccatctggagactctgtccacctccacagaagccaggagaaaaaagcgtttccaaggacggaagactgttaatttgtccattccactaagtgaaacatcttccaccaaactgtcccacattgatgaatacatttcctcatctccaacctaccagaccgtgcctgattttcagagagtgcagattactggtgactatgcctctggggttacagttgaagattttgaaattgtttgcaaaggtctgtatcgggcactatgcatacgtgagaaatacatgcagaagtcgtttcagaggttccctaaaaccccttccaaatacttgcggaacattgatggtgaggcttgggtagcaaatgagagcttctatccagtctttactcctcctgtgaagaagggagaggaccccttccgaacagacaaccttcctgaaaacctgggctatcacctcaaaatgaaggacggtgtagtttacgtctatcctaatgaagcagcagtcagcaaagatgagcctaagccacttccttacccaaatctggacaccttcttagacgatatgaattttttacttgctttaattgctcaaggacctgttaagacctatacccaccggcgcctgaagttcctctcctccaagttccaggtccatcagatgcttaacgagatggacgagttaaaggagctgaaaaacaacccccaccgagatttttataactgcaggaaggtggacacccatatccatgcagccgcttgcatgaaccagaaacatctgctgcgttttattaagaaatcttaccaaattgatgctgacagagtggtctatagcaccaaagagaagaatctgaccctaaaggaactttttgctaaattaaaaatgcatccttatgacctgactgttgattctctggatgttcatgctggacgccagaccttccagcgttttgataagttcaatgacaaatataatcctgtaggagcaagtgagctacgggacctctacttgaagacagacaattacattaatggggaatattttgccactatcatcaaggaggtaggtgcggacctggtggaggccaagtaccagcatgctgagccccgcctgtccatctatggccgcagtcctgatgagtggagcaaactctcctcctggttcgtctgcaatcgcatccactgccccaacatgacatggatgatccaggttcccaggatctatgatgtgttccgttccaagaatttccttccacattttggaaaaatgctggagaatattttcatgccagtgtttgaggccaccatcaacccccaggctgacccagaactcagtgtcttcctcaagcatatcactggctttgacagtgtggatgatgagtccaaacacagtggccacatgttctcctccaagagtcccaagccccaggagtggacattggaaaagaatccatcttacacttactatgcctactacatgtatgcaaacatcatggtgctcaacagcctgagaaaggaacgaggcatgaatacgtttctgttccgacctcactgtggagaagctggagccctcacccatctcatgacagcattcatgatagcagatgatatctctcatggcctaaatttaaaaaagagtcccgtgctacagtacttgtttttcttagcccaaattcccatcgccatgtcaccactaagtaacaatagcctatttctagagtatgccaaaaatccttttttggatttccttcagaaagggctaatgatctcactgtctacagatgacccaatgcaattccactttaccaaggagcccctaatggaagaatatgctattgctgcacaagtcttcaagctgagcacctgtgatatgtgcgaagtggcaaggaacagtgtcttgcagtgtggaatttctcatgaggagaaagtaaagtttctgggcgacaattaccttgaggaaggccctgctggaaatgatatccggaggacaaatgtagcccaaatccgcatggcctatcgctatgaaacctggtgttatgaactcaatttaattgctgagggtcttaaatcaacagaataaaaaaaagtaaaccaaa

SEQ ID NO: 105188 - DNA, 3899 bp, Homo sapiens
  Payload ID: 640
  Gene Symbol: AMPD2
  Gene Name: adenosine monophosphate deaminase 2
  Uniprot ID: Q01433
  ENST ID: ENST00000256578
  CDS Start-End: 361-3000
gggtgctgggttttcacggagtatgcctgccctgccccgggaggactgtgtttgagcttggactcgctcgctgctgaattcctgtttgttattcttttttcttccaggctagctggaaggaccagctagcctggactttggcttctttgcccgggagccctggcatgatggggtgagggctcttggtgggttagtggagagctgggggctggcccttccccatcttcttttctacccaccccctccccgccccccgccaggcccagccaccatcagtcacgtcactcctgggactgaggaggcaggggagggataaggggcagagatggaggccccactccccgaggttgcctagacaacatgagaaatcgtggccagggcctcttccgcctgcggagccgctgcttcctgcatcagtcactcccgctgggggcggggcggaggaaggggttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 105189 - DNA, 3728 bp, Homo sapiens
  Payload ID: 640
  Gene Symbol: AMPD2
  Gene Name: adenosine monophosphate deaminase 2
  Uniprot ID: Q01433
  ENST ID: ENST00000342115
  CDS Start-End: 433-2829
aagggccgcagagcctggcgcggagccggcgagattttggtggggtctcacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 105190 - DNA, 2838 bp, Homo sapiens
  Payload ID: 640
  Gene Symbol: AMPD2
  Gene Name: adenosine monophosphate deaminase 2
  Uniprot ID: Q01433
  ENST ID: ENST00000358729
  CDS Start-End: 35-2449
ctcccgctgggggcggggcggaggaaggggttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagttta

SEQ ID NO: 105191 - DNA, 3130 bp, Homo sapiens
  Payload ID: 640
  Gene Symbol: AMPD2
  Gene Name: adenosine monophosphate deaminase 2
  ENST ID: ENST00000369840
  CDS Start-End: 1-2584
gttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtcagagcccagcaggcagccaggcgggcgggcgagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctga

SEQ ID NO: 105192 - DNA, 3217 bp, Homo sapiens
  Payload ID: 640
  Gene Symbol: AMPD2
  Gene Name: adenosine monophosphate deaminase 2
  Uniprot ID: Q01433
  ENST ID: ENST00000393688
  CDS Start-End: 38-2320
actctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagt

SEQ ID NO: 105193 - DNA, 585 bp, Homo sapiens
  Payload ID: 640
  Gene Symbol: AMPD2
  Gene Name: adenosine monophosphate deaminase 2
  ENST ID: ENST00000527846
  CDS Start-End: 1-585
gagtgtgtgcttcctggcctcaggatagatgctgggctctgtcttgccacctctcgcccaaggtgctggtcccctcagagggggccacctcctccggcatcctctctgtggtggtgcccctcaacctcagtcccagggacagccggcttggaagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggag

SEQ ID NO: 105194 - DNA, 575 bp, Homo sapiens
  Payload ID: 640
  Gene Symbol: AMPD2
  Gene Name: adenosine monophosphate deaminase 2
  ENST ID: ENST00000531203
  CDS Start-End: 315-575
gagctgggctaccccgggagctgagggtcagatgtggaaggaaaatgactggtgcaaggtctctactgtcctgagggtgttctctgtgcccaggtctgtgccatccagaaagggtgtcccctgggtggggcccttcctggccctgtttggttcagcaatagggcaactgatacggatctagcccagagctggagacccttcggtggtcagatgaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggt

SEQ ID NO: 105195 - DNA, 814 bp, Homo sapiens
  Payload ID: 640
  Gene Symbol: AMPD2
  Gene Name: adenosine monophosphate deaminase 2
  ENST ID: ENST00000474459
  CDS Start-End: 423-426
gagcctggcgcggagccggcgagattttggtggggtctcacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatgg

SEQ ID NO: 105196 - DNA, 572 bp, Homo sapiens
  Payload ID: 640
  Gene Symbol: AMPD2
  Gene Name: adenosine monophosphate deaminase 2
  ENST ID: ENST00000531734
  CDS Start-End: 262-572
attactgtgcatacatcatcctgatgtctgtgacctcctgcctctgcctctatcgtcagttcctgtgcctttcctgtggctgtcccactttatgatcacatttacgaacagtttcctgatgaagtaaataagtgccagggcaggggcccttggagtgacttggctggggtctgtggcccgatccccctgccgtccctcaggacccgggctttctgctgtacagacttctcgtgggcagcctcccctcggaactcgggcatcatggcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagattt

SEQ ID NO: 105197 - DNA, 588 bp, Homo sapiens
  Payload ID: 640
  Gene Symbol: AMPD2
  Gene Name: adenosine monophosphate deaminase 2
  ENST ID: ENST00000528270
  CDS Start-End: 1-252
gctgtcgccgccgtggtcccagccatggcatcctatccatctggctctggcaagcccaaggccaaatatccctttaagaagcgggccagcctgcaggcctccactgcagctccagatgactggtgcaaggtctctactgtcctgagggtgttctctgtgcccaggtctgtgccatccagaaagggtgtcccctgggtggggcccttcctggccctgtttggttcagcaatagggcaactgatacggatctagcccagagctggagacccttcggtggtcagatgaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcct

SEQ ID NO: 105198 - DNA, 513 bp, Homo sapiens
  Payload ID: 640
  Gene Symbol: AMPD2
  Gene Name: adenosine monophosphate deaminase 2
  ENST ID: ENST00000469039
  CDS Start-End: 510-513
agagcctggcgcggagccggcgagattttggtggggtctcacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcagggcctcttccgcctgcggagccgctgcttcctgcatcagtcactcccgctgggggcggggcggaggaaggggttggatgt

SEQ ID NO: 105199 - DNA, 3134 bp, Homo sapiens
  Payload ID: 640
  Gene Symbol: AMPD2
  Gene Name: adenosine monophosphate deaminase 2
  Uniprot ID: Q01433
  ENST ID: ENST00000528667
  CDS Start-End: 495-3134
cacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcaggcccagccaccatcagtcacgtcactcctgggactgaggaggcaggggagggataaggggcagagatggaggccccactccccgaggttgcctagacaacatgagaaatcgtggccagggcctcttccgcctgcggagccgctgcttcctgcatcagtcactcccgctgggggcggggcggaggaaggggttggatgtggcagagccaggccccagccggtgccgctcagactcccccgctgtcgccgccgtggtcccagccatggcatcctatccatctggctctggcaagcccaaggccaaatatccctttaagaagcgggccagcctgcaggcctccactgcagctccagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatga

SEQ ID NO: 105200 - DNA, 1111 bp, Homo sapiens
  Payload ID: 640
  Gene Symbol: AMPD2
  Gene Name: adenosine monophosphate deaminase 2
  ENST ID: ENST00000476688
  CDS Start-End: 1-695
cggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgag

SEQ ID NO: 105201 - DNA, 2728 bp, Homo sapiens
  Payload ID: 640
  Gene Symbol: AMPD2
  Gene Name: adenosine monophosphate deaminase 2
  Uniprot ID: Q01433
  ENST ID: ENST00000528454
  CDS Start-End: 378-2663
cacatctggctgggtcttccctggcactgtagaggtggaggccctcttcagttctggagttcgtcttatctcccaactctgatgctccttcccttggtttctgggctcccttgaactcccctagctccgtgctcacggccatctcagggtctcccctgcttgcagctgcacttggtacagcctgtgccagcccctgagggaccggctgcagcttcactggcaaacaggcgggcaaggggcacagggctgctggccggagctgcctgcactctgcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcc

SEQ ID NO: 105202 - DNA, 3680 bp, Homo sapiens
  Payload ID: 641
  Gene Symbol: AMPD3
  Gene Name: adenosine monophosphate deaminase 3
  Uniprot ID: Q01432
  ENST ID: ENST00000396553
  CDS Start-End: 135-2438
tcaaccctgcttggttttagaggattgctcctgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaa

SEQ ID NO: 105203 - DNA, 3806 bp, Homo sapiens
  Payload ID: 641
  Gene Symbol: AMPD3
  Gene Name: adenosine monophosphate deaminase 3
  Uniprot ID: Q01432
  ENST ID: ENST00000396554
  CDS Start-End: 342-2672
tgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaa

SEQ ID NO: 105204 - DNA, 3994 bp, Homo sapiens
  Payload ID: 641
  Gene Symbol: AMPD3
  Gene Name: adenosine monophosphate deaminase 3
  Uniprot ID: Q01432
  ENST ID: ENST00000444303
  CDS Start-End: 473-2299
gtggacggttggcgagggagtgtgtgtgtgtgtgtgtgtgtgtgtgtgtgtgtgtatccaagtgaccagaaggacgcctggaagaaaccaatgcttgcgggttgctgcaactacagggagcaagtcacctgtgcggggccgagacccccagagtctcgcgctgggaaaagttgtgcggggaggggaggacgtcggctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 105205 - DNA, 3156 bp, Homo sapiens
  Payload ID: 641
  Gene Symbol: AMPD3
  Gene Name: adenosine monophosphate deaminase 3
  Uniprot ID: Q01432
  ENST ID: ENST00000529507
  CDS Start-End: 291-2594
atagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttgg

SEQ ID NO: 105206 - DNA, 576 bp, Homo sapiens
  Payload ID: 641
  Gene Symbol: AMPD3
  Gene Name: adenosine monophosphate deaminase 3
  ENST ID: ENST00000532250
  CDS Start-End: 244-576
cacagagaggaggacatcagcatggagagactgcagatcagtcccagcaaacctgtggaggccagttaaatgcctggagctcatcccctgccattcaaacggggtcttgctctgttgcctggctggagtgcagtggtgctaacatgactcactgcacccttgacctcctggactcaagtgatcctcccacctcagcctcccaagtagctgggactccaagtgggtgccactacagccactgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccct

SEQ ID NO: 105207 - DNA, 980 bp, Homo sapiens
  Payload ID: 641
  Gene Symbol: AMPD3
  Gene Name: adenosine monophosphate deaminase 3
  ENST ID: ENST00000524866
  CDS Start-End: 180-980
gttggcggcgcggcccgggcgcttcaggtagcctctcggctctctctgctccgctccgcgcccagaggattgctcctgtgggtcacttgaggcaggctccaccttccccaggaggagtggcagagtccagccagcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgat

SEQ ID NO: 105208 - DNA, 531 bp, Homo sapiens
  Payload ID: 641
  Gene Symbol: AMPD3
  Gene Name: adenosine monophosphate deaminase 3
  ENST ID: ENST00000533116
  CDS Start-End: 1-333
gcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacagggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctac

SEQ ID NO: 105209 - DNA, 2376 bp, Homo sapiens
  Payload ID: 641
  Gene Symbol: AMPD3
  Gene Name: adenosine monophosphate deaminase 3
  ENST ID: ENST00000534047
  CDS Start-End: 81-719
agtgcccagcagccccgctccgctctgcccagcgcgtcccctttgctccagccctgcggccgtccctttcggccggcggcatggccctgtcgtccgaacccgctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttaggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactag

SEQ ID NO: 105210 - DNA, 593 bp, Homo sapiens
  Payload ID: 641
  Gene Symbol: AMPD3
  Gene Name: adenosine monophosphate deaminase 3
  ENST ID: ENST00000529744
  CDS Start-End: 1-273
ccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagc

SEQ ID NO: 105211 - DNA, 2248 bp, Homo sapiens
  Payload ID: 641
  Gene Symbol: AMPD3
  Gene Name: adenosine monophosphate deaminase 3
  ENST ID: ENST00000529834
  CDS Start-End: 48-2081
agcgctcggagctggaggcccacgtgggagcagtgagcggctctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgag

SEQ ID NO: 105212 - DNA, 2753 bp, Homo sapiens
  Payload ID: 641
  Gene Symbol: AMPD3
  Gene Name: adenosine monophosphate deaminase 3
  Uniprot ID: Q01432
  ENST ID: ENST00000528723
  CDS Start-End: 202-2526
attcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccgggatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgaaaacctattgtcaccggcgactgaactttctggaatccaagttcagccttcatgagatgttaaacgaaatgtccgagttcaaagagttgaagagtaacccccaccgggacttctataacgtgagaaaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcgggccggcagacattccaccgctttgacaagttcaactccaaatacaaccctgtgggggccagtgagctgcgtgacctgtatttgaaaactgaaaactatctgggaggagagtactttgctcggatggtcaaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttatgacatatttaggtcaaagaagctgctgccaaactttgggaagatgctggagaacatcttcctgccccttttcaaggccactatcaacccccaagatcatcgagagcttcacctcttccttaaatatgtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcagggagcgcggcctgagcacgttcctgttccggccgcactgtggggaagccggctccatcacccacctggtgtctgccttcctcactgctgacaacatttcccacgggctgctcctcaagaagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggaagcacttatggaagaatatgccattgcagctcaagtgtggaagctgagcacctgcgacctgtgtgagatcgccaggaacagcgtgctgcagagcggcctctcgcatcaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctg

SEQ ID NO: 105213 - DNA, 2143 bp, Homo sapiens
  Payload ID: 642
  Gene Symbol: AHCY
  Gene Name: adenosylhomocysteinase
  Uniprot ID: P23526
  ENST ID: ENST00000217426
  CDS Start-End: 79-1377
cggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 105214 - DNA, 2366 bp, Homo sapiens
  Payload ID: 642
  Gene Symbol: AHCY
  Gene Name: adenosylhomocysteinase
  Uniprot ID: P23526
  ENST ID: ENST00000538132
  CDS Start-End: 388-1602
ctggagggaggggcgtggatacagcgggaaaggagagacccctagcggggtggacaagaagggaggaactccacagaactgcttaatccggctccatccccatcagcgggctttctcagcgcctgcacccctctctatcccatctcgaagcctccagttaatccagagtgagacgcaggaccgccgggaggcgagcggggatgctgaagctagggcaggctaaagccccgcggccaaagggcaggcttgtgcgccctccgccccctctccgccccctctccgcccctccgcgcccaggacctaattgtttgcaaaagcaaacacggaaaagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctgg

SEQ ID NO: 105215 - DNA, 2503 bp, Homo sapiens
  Payload ID: 643
  Gene Symbol: AHCYL1
  Gene Name: adenosylhomocysteinase-like 1
  Uniprot ID: O43865
  ENST ID: ENST00000359172
  CDS Start-End: 343-1794
gcttctgactgtggaattggattctagctgtgtgtgtgttatatcctgttactgttgagacacagaggcgggagtcggcgggggaagatatgtgctgagattagtcagcctgccctccctctcccccaagaaactcaggccccatctggggagagtgagaacttaagaaacttgagacagggaaggagagccgggagcagccaaaacctgctaagtctcagaagactggtttctgcacaagggaatggaagaagtgactggaggtggctgtggattcaactctggcctgagattgattcccttgagataagttgttttctgcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaaa

SEQ ID NO: 105216 - DNA, 4015 bp, Homo sapiens
  Payload ID: 643
  Gene Symbol: AHCYL1
  Gene Name: adenosylhomocysteinase-like 1
  Uniprot ID: O43865
  ENST ID: ENST00000369799
  CDS Start-End: 368-1960
cagagtgccctttctccccgcctcttccccctcccgggagctgccagtacttgacgtggcgtcaccgccctctaccctcgctttgcgtgcgtgtttgcgtacagcggaggtggcggcgcgggcaggtcggagctcggagctgctgttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataa

SEQ ID NO: 105217 - DNA, 4313 bp, Homo sapiens
  Payload ID: 643
  Gene Symbol: AHCYL1
  Gene Name: adenosylhomocysteinase-like 1
  Uniprot ID: O43865
  ENST ID: ENST00000393614
  CDS Start-End: 801-2252
gctttgcgtgcgtgtttgcgtacagcggaggtggcggcgcgggcaggtcggagctcggagctgctgttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaaggtgcgggggctctgggtggcggcgggggctcgggctccggcctcgcggaagggacgcgagcaagcccgggctctggctagtttgggacttctgggggtgactggggacggcggaggtgatgtagggggtggcggctgtgcggccccaggcctctcccgggctgaaaggccgcctctgacctcgctttcctttgtccctcggcccaagtcctccgggatcgttttgaaacccgacagggccaggccttaaatttgcgactgacttttcctggatgaagggcctcgaagacgagagtgggagggggtgaaccaactcagctgacccttgtgaccagtccgggggcatggggtgtacagaaaatctcccttcagcaaatccagtttgctgatgacatgcaggagttcaccaaattccccaccaaaactggccgaagatctttgtctcgctcgatctcacagtcctccactgacagctacagttcagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaagacatgtctgctctgatttcactcaggaaacgtgctcagggggagaagcccttggctggtgctaaaatagtgggctgtacacacatcacagcccagacagcggtgttgattgagacactctgtgccctgggggctcagtgccgctggtctgcttgtaacatctactcaactcagaatgaagtagctgcagcactggctgaggctggagttgcagtgttcgcttggaagggcgagtcagaagatgacttctggtggtgtattgaccgctgtgtgaacatggatgggtggcaggccaacatgatcctggatgatgggggagacttaacccactgggtttataagaagtatccaaacgtgtttaagaagatccgaggcattgtggaagagagcgtgactggtgttcacaggctgtatcagctctccaaagctgggaagctctgtgttccggccatgaacgtcaatgattctgttaccaaacagaagtttgataacttgtactgctgccgagaatccattttggatggcctgaagaggaccacagatgtgatgtttggtgggaaacaagtggtggtgtgtggctatggtgaggtaggcaagggctgctgtgctgctctcaaagctcttggagcaattgtctacattaccgaaatcgaccccatctgtgctctgcaggcctgcatggatgggttcagggtggtaaagctaaatgaagtcatccggcaagtcgatgtcgtaataacttgcacaggaaataagaatgtagtgacacgggagcacttggatcgcatgaaaaacagttgtatcgtatgcaatatgggccactccaacacagaaatcgatgtgaccagcctccgcactccggagctgacgtgggagcgagtacgttctcaggtggaccatgtcatctggccagatggcaaacgagttgtcctcctggcagagggtcgtctactcaatttgagctgctccacagttcccacctttgttctgtccatcacagccacaacacaggctttggcactgatagaactctataatgcacccgaggggcgatacaagcaggatgtgtacttgcttcctaagaaaatggatgaatacgttgccagcttgcatctgccatcatttgatgcccaccttacagagctgacagatgaccaagcaaaatatctgggactcaacaaaaatgggccattcaaacctaattattacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagacctt

SEQ ID NO: 105218 - DNA, 5056 bp, Homo sapiens
  Payload ID: 644
  Gene Symbol: AHCYL2
  Gene Name: adenosylhomocysteinase-like 2
  Uniprot ID: Q96HN2
  ENST ID: ENST00000325006
  CDS Start-End: 55-1890
gccgaccaagagcaggagctggagtctgagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagcagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctgtagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgga

SEQ ID NO: 105219 - DNA, 5026 bp, Homo sapiens
  Payload ID: 644
  Gene Symbol: AHCYL2
  Gene Name: adenosylhomocysteinase-like 2
  Uniprot ID: Q96HN2
  ENST ID: ENST00000446544
  CDS Start-End: 28-1860
gagccggtggttgcagcggaggcggtgatgtcggtgcaggttgtgtcagccgcggctgccgccaaggtgcctgaggtggagctgaaggacctgagcccctccgaggcggagtcgcaactaggactgagcacggccgccgtgggcgccatggcccccccggcgggcggtggagaccctgaggctccagctcccgccgcggagcggcccccggtccccggcccgggctcggggcccgccgccgctctcagccccgccgccgggaaggtgcctcaggcgtcggccatgaagcggagcgacccacatcaccagcaccagcggcaccgcgacggcggcgaggccctggtcagccccgacggcaccgtcaccgaggcgccgcgcacagtcaagaagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgtagtgttggcccagagtgtggttactgccctgagggccatgaaagccacagaggatgggctgaggaaggaaagaaatggggttactgctcccagtgcatcatttgcatcattccccattgactgaatcctcagcagtggccgtttttcctcttgtccaggctcacgagttagtccagggattccatactccctattccctggagttttctggaataaattttcagcacctgcttttctcagcttggcccttccccgggtgaggccgtttggaattaacatggccagtgtttcacacaagattgggttcccaatcttgaccatcactatcactgccttctttatataaaggctaataaggaaggagtgttatttatggctttgccaagctacatcaagaactcagctgtgctgtgcctaccaggggtctcctttcttacccaggactcctttcttctccttgaatatttatgtccattttaacacttcctggttgcaagagggatgtgcctccattatttcctccacagttttggtatttgtcagacatttgttctgctgtctttctaatccagccaacgtctgctcaggaagtggggccagctccactgggacccatagttttacttccttgtcatttgattggatagtttccaaggaagcccctccagattggcactatctcagaaaaggagagcttgttgtgaaacactgcttcctgaaacttcctgctattgcctaaagctacgtctgaaactgagtagggaaaggcatacttttccagggacttagggggataggctttggaaatgggacaggtctttcagactcacagcttgataccctaacaaagcagagtatatttatttgtttcccaggaaggccattgcagtttgactggctgagggatacagagatgaaattgtaaactgtatccagattatcaaagctaatttgactagtttgaacctcgtcagacattcattcctttggccattgccatggatgaaaccgagatctgcagtctgatctgtggacttctctgctggcatatcttttatgatttaacctcttccatttgatgattctgtatttcagagtcagtttcttgagtaactccagtgctacaaaaagaattagtaatgtggtgtgggcagcgtgacattttatgtcccacccaaaaattggattccttttggagactgatctgttggtctcaggcatttcattaggaccagattggttctaagagttagtctggactggccctaggaaacttgaattaaataagcctcttccccttaccgatcctttttaacactctcaggtttgtttgtttcccacttttttcctatgctggtctgcctcaaagtctcaagaccaaggtgactcaagataacaccagaccacgcatgatcaccaaaaccttcccatcctgattctcttcttctacctctaccctctccaacttctcctggtcttcacatatactctcaaagctagtctgaaagtgaccttactttcggaagtagggaagtggaactttggtaaatgactgtttgcctcatttaatagtatacaggctcagcccatagactacagttcttcagaggccatatgtctcagcaagtactggttatattctttttttgtaaggaagatcataaatgctaaaaattccactaagccattcagttcttccttttgcctacctagtcctgatttttgtattaattggttccctttagcaagggattcagatctttgtaccttatcttatatccagagcagattccatttggcagatagatggtctctagcctattgtattcttagaccaaaaatcataacctgctgtttctcagcaaagccttgctctctggagcttactatgtgctggtacttaaagagtacattctgccttgctgtagtgaagagacccactccaaataaaaaaggggccacacggggcttctaagttaggttgccagtgttgctgcccatgatgagttatttgcctctgagtttcagatgacctctctgtagggacactgtgttatcaaccattaagaagaaagaaccacaagcctcccaagtatttgggttctatcttagggttgaaatctggtcattattccctctacccttggaatcagagcaatgtgtcttctttcctccaacctcttaccttagatgcatcctggttatctggaagcatgggaaagaaggctacttatctctttgtatgtggctccagtctgtgaggatacataacattttctctacaatgaatctgtgctaatattttgccttctttctttcttttcttttcacccttagagacagggtttcactatgttgcccaggctggtctcaaactcctgggctcaagcaatcctcctgcctcagcttcctgagtagctggaaccacaggtgtgtgctaccgtgcctggcacttttttgccttcttaatggagatattcagttttctttttttcatttaaacaaagaaaaaaaatgtatctactctaccttccctctgctctcctccctccctatcctacttgcccatatgagcacggctccccatggccacatactcctgcaaagcttttatgctgcttcgcttttctctaaacagatctgatattgctgctcctgtggttttctcaaaattaactttgccgtggtttttaaaaaggaatcaaaatgcattgttgcattaagctttttcaataaaggaaaattacggaaggaaaataggcaacaccagcaaattatatgtggacaggttctaaactctatatatacatatatatatatatatctatatatctatatacgtaatcatctagttctgtcatcttactgaaaggaataacacttctaaagatcaccatttctgagaagttcttggaaatctttatgtctaagtgattgtattagatcagcaataatgactatgtaatctcaaaaaacaaataaaatattcttaacatgga

SEQ ID NO: 105220 - DNA, 1723 bp, Homo sapiens
  Payload ID: 644
  Gene Symbol: AHCYL2
  Gene Name: adenosylhomocysteinase-like 2
  ENST ID: ENST00000466924
  CDS Start-End: 1-1556
gcaggaagtggagccgtcagttcctgctttcattctggtgtactgtatgttctgcccatcaaggaaccatctttttatcattaaagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctgt

SEQ ID NO: 105221 - DNA, 581 bp, Homo sapiens
  Payload ID: 644
  Gene Symbol: AHCYL2
  Gene Name: adenosylhomocysteinase-like 2
  ENST ID: ENST00000466993
  CDS Start-End: 34-581
cacagaggtggcagtggggctggtaatgtcactatgctgggcagcaagaagaaatacattgttaatggcaactctgggattaaggcccagcagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtc

SEQ ID NO: 105222 - DNA, 599 bp, Homo sapiens
  Payload ID: 644
  Gene Symbol: AHCYL2
  Gene Name: adenosylhomocysteinase-like 2
  ENST ID: ENST00000460109
  CDS Start-End: 373-599
aaagaaggaagtccaactattgctgcagaaagtccccactggggaggtgcgggtagagtgtttgggtagcattaaaacagtgagtgccctgtgagaagcacagtgcctgggtgcagcactttgcatcagctctgattttgaaatcagacacagaaggctttgaagccggccagtaaggggttgtcaggcagttgactaatgctcttgatttgaatcggaggctgctgtgaaaagggatgcagcttctgctagccactgtgaacttctgaatctcactagggttgggtctgctttggggcactcagataaccccagtatttccaaaccagctttcccttttgcttcaggacatatcttacccaagcctgcactatggagaagtgggacggtaatgagggcacctcagcttttcacatgcctgagtggatgcagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaa

SEQ ID NO: 105223 - DNA, 2047 bp, Homo sapiens
  Payload ID: 644
  Gene Symbol: AHCYL2
  Gene Name: adenosylhomocysteinase-like 2
  Uniprot ID: Q96HN2
  ENST ID: ENST00000474594
  CDS Start-End: 355-1881
attgctgcagaaagtccccactggggaggtgcgggtagagtgtttgggtagcattaaaacagtgagtgccctgtgagaagcacagtgcctgggtgcagcactttgcatcagctctgattttgaaatcagacacagaaggctttgaagccggccagtaaggggttgtcaggcagttgactaatgctcttgatttgaatcggaggctgctgtgaaaagggatgcagcttctgctagccactgtgaacttctgaatctcactagggttgggtctgctttggggcactcagataaccccagtatttccaaaccagctttcccttttgcttcaggacatatcttacccaagcctgcactatggagaagtgggacggtaatgagggcacctcagcttttcacatgcctgagtggatgatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttaggttatttatttattaaaatcaagaatcctgtgcctg

SEQ ID NO: 105224 - DNA, 1884 bp, Homo sapiens
  Payload ID: 644
  Gene Symbol: AHCYL2
  Gene Name: adenosylhomocysteinase-like 2
  Uniprot ID: Q96HN2
  ENST ID: ENST00000490911
  CDS Start-End: 228-1754
aatggctgttgagccactaacagaaatgccttattaaattggggctgtactgctgaaggggttgttggagctgcttcagggattccaaggaagagtagtcccccactccccagcccaaaaagctggctggaaccagagccaacagaattgctgatgaggaaagtttaaaggcctgatcacaagggtccctggaccacagaggtggcagtggggctggtaatgtcactatgctgggcagcaagaagaaatacattgttaatggcaactctgggattaaggcccagatccagtttgctgaccagaagcaagaattcaacaaacgtcccaccaaaattggacgtcgctctttgtctcgttccatttctcagtcatctactgacagctacagctcagcggcttcatatacagatagctctgatgatgagacatcgcccagggacaagcagcaaaagaactctaagggaagcagtgacttctgtgttaagaacatcaaacaggcagagtttggacgaagagaaattgaaattgctgaacaagaaatgcctgcattgatggctttgaggaagagagctcaaggagaaaagcctttggctggagccaaaatcgtgggttgcacacacatcactgctcagactgctgtgcttatggaaactctgggtgctctgggggcccagtgccgatgggctgcctgcaacatctattccactctcaatgaagtggctgctgctctagcagaaagtggatttcctgtttttgcctggaagggagagtcagaagatgacttttggtggtgtatcgatagatgtgtgaatgtggagggctggcagccaaacatgatcttggatgatggaggggatcttacccactggatttataaaaagtatcccaacatgtttaagaaaatcaagggcatagtagaggagagtgttactggagttcacaggctgtaccaactgtccaaagctgggaagctgtgtgttccagccatgaatgtcaatgactcagtcaccaaacagaaatttgacaacctctactgttgccgtgaatcaattcttgatggacttaaaaggacaacagacatgatgtttggtggaaagcaagtggtagtctgtggctatggagaggtggggaaagggtgctgtgctgccctgaaagccatgggctccattgtgtatgtaactgaaattgaccccatctgtgccctgcaagcctgtatggatggatttcgactggtgaaattaaatgaggtcatccgacaagtggacattgttattacctgtacaggtaacaagaatgtggtaaccagagagcacttggaccgtatgaagaatagctgcatcgtttgtaacatgggacattccaacacagagattgacgtggcgagtctgcggacaccagaactgacctgggagcgagtgagatctcaagttgaccatgtgatatggcctgatggcaagaggatagtactgctggcagagggccgcctgctgaaccttagctgctccacagtgcctacatttgtgctctcaatcactgctactactcaggctcttgccttgatagagctttacaatgctcctgagggtcgctataagcaggatgtctacctgttgcccaagaagatggatgagtatgtggccagcctacacctgcctacctttgatgcccacttgacagagctgacagatgaacaggccaagtatctgggactcaacaagaatgggcccttcaagcctaattactacaggtattaagttcctgtaactcaaaccagaatttttaaggaatagaactccaagccttttctccactactatacaagaaagaattcagcaagctgcttctccaatcaaagctgcctgccgtgctcaccctgtgtgttag

SEQ ID NO: 105225 - DNA, 3040 bp, Homo sapiens
  Payload ID: 645
  Gene Symbol: AMD1
  Gene Name: adenosylmethionine decarboxylase 1
  ENST ID: ENST00000368876
  CDS Start-End: 146-943
gggccccaggtgggggtcgggggcgcctgcgcgggttgcctccggcagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaa

SEQ ID NO: 105226 - DNA, 1605 bp, Homo sapiens
  Payload ID: 645
  Gene Symbol: AMD1
  Gene Name: adenosylmethionine decarboxylase 1
  ENST ID: ENST00000368877
  CDS Start-End: 442-1239
gcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaa

SEQ ID NO: 105227 - DNA, 3059 bp, Homo sapiens
  Payload ID: 645
  Gene Symbol: AMD1
  Gene Name: adenosylmethionine decarboxylase 1
  ENST ID: ENST00000368882
  CDS Start-End: 323-967
cgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaaggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattc

SEQ ID NO: 105228 - DNA, 3438 bp, Homo sapiens
  Payload ID: 645
  Gene Symbol: AMD1
  Gene Name: adenosylmethionine decarboxylase 1
  Uniprot ID: P17707
  ENST ID: ENST00000368885
  CDS Start-End: 337-1341
tcacgcagcgctctcgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaa

SEQ ID NO: 105229 - DNA, 3121 bp, Homo sapiens
  Payload ID: 645
  Gene Symbol: AMD1
  Gene Name: adenosylmethionine decarboxylase 1
  ENST ID: ENST00000451850
  CDS Start-End: 337-483
tcacgcagcgctctcgcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaa

SEQ ID NO: 105230 - DNA, 782 bp, Homo sapiens
  Payload ID: 645
  Gene Symbol: AMD1
  Gene Name: adenosylmethionine decarboxylase 1
  ENST ID: ENST00000465404
  CDS Start-End: 1-18
gattctttccattcttaacactgtgaactttttctctcagggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacat

SEQ ID NO: 105231 - DNA, 3182 bp, Homo sapiens
  Payload ID: 645
  Gene Symbol: AMD1
  Gene Name: adenosylmethionine decarboxylase 1
  ENST ID: ENST00000610605
  CDS Start-End: 293-1090
ctacccagggccggagcggcaactccgcagcggagctctgcctgcccgctgcgttcccccaagagactagaccccacaaactcctcctccaccgcggtcccaactcgagtccccccgccgtctccgagcactcggagggcgcccctctgggacgggaccgacgcctcggaccgggctgcgccgcgggagttcgagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattc

SEQ ID NO: 105232 - DNA, 12503 bp, Homo sapiens
  Payload ID: 646
  Gene Symbol: ADCY1
  Gene Name: adenylate cyclase 1 (brain)
  Uniprot ID: Q08828
  ENST ID: ENST00000297323
  CDS Start-End: 23-3382
gcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccgttctcagcctgctggcgggcgcgctggcgctggccgagctgctgggcgcgccggggcccgcgcccggcctggccaagggctcacacccggtgcactgcgtcctcttcctggcgctgctcgtggtaaccaacgtccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaagcggagggcattaagaacagcctcggaaaaactcagaaaccgctcatctttttctaccaacgttgtctacaccaccccgggcactcgcgtcaacaggtacatcagccgcctcttagaagcccgccagacagagctggagatggcagacctgaacttctttaccctgaagtacaaacatgtcgaacgggagcaaaagtaccaccagcttcaggacgagtatttcaccagcgccgttgtcctcaccctcatcctggctgccttatttggccttgtctaccttctaatattcccacagagtgtggtcgtcctgctcctgctagtattctgcatctgcttcctggtggcctgtgtcctgtacctgcacatcacccgggtccagtgttttccagggtgcctgacgattcagattcgcactgtcctgtgtattttcatagtggtcttaatctactcagtagcccaaggttgtgtggtgggctgcctgccttgggcctggagctccaagcccaacagttccctggtggtcctttcgtctgggggccagcgcacagccctgcccaccctgccctgcgagtctacacaccatgccctgctctgctgcctggtgggcaccctcccgctagccatatttttccgggtgtcctccttgccaaaaatgatcctgctctccgggctcaccacgtcctacatcctcgttctggagctcagcggatacaccaggactgggggtggtgccgtctccgggcgcagctacgagccgattgtggccatcctgctcttctcctgtgcgctggccctgcatgccaggcaggtggacatcaggctgaggctggactacctctgggccgcacaggcagaggaggagcgagaggacatggagaaggtgaagctggacaacaggcgcatcctcttcaacctcctgccggcccacgtcgcccagcacttcctcatgtccaaccctcggaacatggacctctactaccagtcctactcccaggtgggcgtcatgtttgcctccatccccaacttcaatgacttctacatcgagctggacggcaacaacatgggggtggagtgtctgcggcttctcaacgagatcatcgccgactttgacgagctcatggaaaaagacttttacaaggacatagagaagatcaagaccatcgggagcacctacatggccgctgtggggctagcgcccacctcggggaccaaggctaagaagtccatctcctcccacctgagcacgctggcggactttgccattgagatgtttgacgttctggatgaaatcaactaccagtcttacaacgactttgtcctccgagttggcatcaatgttggccctgtggtggctggagtgattggcgctcgcaggccccagtacgacatctggggaaacacagtcaacgtggccagtcggatggatagcacaggggtccagggcagaatccaggtgactgaggaagtccaccggctgctgagaaggtgcccctaccactttgtgtgccgaggcaaagtcagtgtcaagggcaaaggcgagatgttgacatactttctagaaggcaggactgatggaaacggctcccaaatcaggtccctgggcttggatcggaaaatgtgtccatttgggagagctggccttcagggcagacgtccccccgtgtgccccatgcctggcgtctcagtcagggctgggctccctccacactccccaggccagtacctgccctctgcagcagctgggaaggaggcttagtggagcccacgtgggcctctggggtgcacatggggtgggaatgctccgggggtgacacaggccacggtggctccagccaggaccagccagaccagcagagcagggagccacttgccagggtggaggaggagcattgtccaggcatggcctgtggcccgagggccaaccaccgagcaggcacagcacagcagtgactcggtgaggggaggacacccgactgtgcacacttccaggcctccctggagaggtgtccactccatccttccctccgtggcgtagggagcactgtttctttccagcaagcctgttcaggtttggccaggtcggcatcaatgtaaggaccttcagagcatcccagggttacagcaagagccactgaggtgtggctggcagagcaactgaggagctctgcgagagtgtgccctctgagacagccctgtccgccccgcccaggtgggacctgacatacaggcggctccagccctgggcagcggcttcaagagccagagtgggaagtcaggcctctctgggaaggtcacaaggcctggggttgttcacaccacaggcacaatacagagctgtccactcttgaactggaccgtctggggagaattgagaagctgcctctcactgcatggatagtggtggctgctggctttcaagcgtggttttttgctaagagccagaggcaggtcttctggagttctcaggggggccctgtgaccccctctccacaaccatggccagcatcggcttcttgctgcacctgtgcattctccacccctccgccaatggcttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttctgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggtgatagtgttgacgtctgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccagcagggttgggggtccgcctcctcactgctcctcaacagctgtaaccctttcctgagggccccgacttttcagaataggagcagagagaagcccagacttccttccctggagtgtagacctgtgtgtgggacctgctccaggctgatccctgtccgcacaggtgggtgatgtccttggctgctgccgtcagaggcagccccctgcacagggaggggctgatcctgcctcagctgtgtggccatgtgggggcagcaggggcctgggccatagctgggggaggccagaccctgagggctttgcagggcggccagtgcagtgatgcctggcgcttccagctgagacaggagtccggacagaggtgggcagggtggatggcttcgggcagggaaggcgggtagaggctgcatgtgggggcccctgtctgcctgtccttagggtgtggattaggctctggcttctgtgatggtgcaagaggcaggatggtctccagacaccttcttgcagagtgattttgaccaatgcctttccagcaccttcccctggttatgacagggagctcccaggccaggccacatgaccccacaggtaggctgaccccatggacccactggagactttgagggcagagctcgggcacctttcatcttccttgggtggtcctcatgtcgctgtccgctcatgttcctggtgttctggcatcaccttgtgccggtgggggctgggctcccgtgaggtcctagggcagaaggaggtgcttgcagggcctctcgctgctactgggacatccacaggacctaatgtttatgtggaatctccaggctgccatcgagggctcctgagctcatcctgaggacccagggtccatctgagctggctgtgggctgagatcctggctggggccctgctgtcaacctctcctccaggccctgccttgtccctgctcctgtgctttcctctcttcaggacaaatggtttgtccttatggtcccctttccactaggattttctcatcctcatctgtctatcccagccggatttaaagcagtcacttcagacaggagccacagggagcctgtgagggagtagtgcggtggtggtgagtgtggctgccctggctcccccagctcaccgtggtgctgtccttgacccacgagctgttgagaagggtgcagagcccctggcacagccaaccctgttgcccccagtgccgctgcccagcttcggccatccaggtggtgggtagacagaggagtgaaccccaaaggtgtccatgccccagttctaagccctgtggccaggtgctgtcacacagcaaaggggactttgcaggtggaattagggttagggatctaaggatgggaggggaacttggtttatctgggtgggctcagtgaccccttggaatggctgagggaggcaggagagcctggaaagattcgaagtgtcacagagatggtgccgtcattgctggcttaaagacaaggggccaggagccaacaccagaggccactccacaaccccagcgccagtcagcaaggaagccgggtgtcgctcacacaaccagaaggagctgagtttggcaacaacccaagtgagcctgaagcagattcgccccagagcctccaggcgtgagtggagcccagtccagcgacaccttggtttggcctgtgagactgagaagagagccagccacgccatgctgtgcctggggtccacagagccgggaggtcacacatgtacatcctggaagctgcccaaggtgtggccacttgtagggcagtgagaggaagccgtcgcggggaccatgctgccttctctgggctcacgactgttctggaaaggaccccatggcagacttggcaaggtctccacttcaggggcaaacatctccatcatcagcaactccaaaccccagccacttcctgggagttcaggaactgtgtttagccataatgtcccttggggtttggtgaaaaacaacttcctttttatttgtgggaaaactgtattatattgccttatttatttttaatcatgtacaatattcatgtacaaatgttagagccattcgggtaggattctctctaaattatttattgaagaggctttgtaaatagtgcaccagtgacaggtgctgcctgtttactcgtaccaaaaatgaagacaagccccacacccacctcagcccttgcttggccatgctgtggccctttggaaatgaccctgtgtgctcccctcgcgacccttgcatgcctttcatgcctgatgccgtagagtagaacacagccccggaatgcttccagttgcttgcaagggaccatgccggcccgggtggtccatgcctgcggggtgtctgtatcctgcaggaggacgcccctacagacccagcaacccaagttgccagcccgtgtttctcagactttaaagccaccagggcttctggaacacctgtcatagaagcaataactctaactctatactgtagagatgagtctggtccgaagcagattagtaatttagagataagccatgcatacaagtttgccccattctctggcttggggtggtgggaggcggggagctgccactcccaaagcctccaccccttcctgaagacccagctatgaaaccgcagttcctgtgggttgggctgcccaggctggtcagagctcagcaccccaggtctggtgagcagacagagccggcgttaaaccccgatcaggtcattgtcaccacacccttgcttggatgaggaaggaaggaggcaaaggcacccactccatccaagatccgttccaattgatgagcctcagtactggcctcacactgaccaacggtggtatgctgcagtttgttggtttggtgcagagtctaaaggataacatatcaaggcttacctgtgataggccattttaaggaaatggtggcactctgaaggctgtccccattcaccttccacaatgctggtaccatcctggtagaagagccctctgaacaggacacctgttcaggcctgggggccccatgctaggcttgcctgggtgtgagaaggtcgaactgggtggcttaggccttcaaattgagcttgggggtgtccaagagaggggtcttattcgaggaactcacataccccaaataaccatcagtgcacaaatcattccatgctctttggcaccaggcaggagatgctgcaggcaggtgtccgtagttggcaaaaatgggcagtaggggaaatggagttgcttcaacctttctcagtcccggccctcactgcacccaccaagtcaagcagagctgggtgggctgagaccagcatcccagctggactgagcctggggggaggggctggagccaaggagcccccctgggtgggggcatcaggagcaggggcagggcctgaggactgctccccctgcatggagggcaggccaggatggagcccagggtagactttgaggaaggctcagtgggctcagcagaaggaaggctcttctcatagttgtggtttttcacagatggatttgggtgatctgagtgtggtcaggccctgccgttggggaatgaatgccacacggggtttgtctgtaagctgcagtgtctgtgattctgtgtgaactgacagcagggagctgaaggacaggccccggccttgggagaggacacgggcatgggctgctggatgcagggctcccagggctgtgaaggcagaggggtctctggaggcagacagggtgggctgggggccagcagcagggggcagagccccagccagggcagctgcttcctgcacatagacattcctcctgcgcagggccaagtgcccatgagcacagccccagacagacacggtggggagcttggagccctccgctcacctagaggagccctgggacacgcactggaaagtattctaggggcttcctgccttatccttctgtttgttcatacacttagtgaaagcagatcctgtactaggatgtgaggatatctgtcacctgcgtggtccattccataaacaccagattccatttcagttgccacacattttggggctagacttccctaaacaacatgccattgtgaaataatgcatatatttgtatttttaaatttccctgaaaatttaatctattctgttccatatgaagtctgtttcactaccttaaaaaatagatactccactagaggctgtgcttaattcaaatccatgtgtgtgcctgcattacatgtgtgaacacgtgtttctgtcgtgtgtgtcatgcacatctgtgtgttgcatagcataagccaaatgaaaatcatttgttcatgggattcatatgaggaacaaaattaaatttgaatacagtcagataactgccacgcagggcatttggggaaccatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcggtgaccgctgcaggaattcggccctccagctcccctccagttaccaggagccgatttggaggccaggccttcccagctgagtgtctgtcagcttcattctctctcagctgtgcagtggaagagcaacaacagacaggtgaccttcttgggttgtgcttcacaatggactgggaaaaacatctttgaaatcaggaaatcaggccgggcgcagtggctcatgcctgtaagcccagcactttgggaggcggaggcgggtggatccattgaggtcaggagctcaagaccagcctggtcaacatggtgaaaccccgtctctactaaaaatacaaaaaaaaaattagctgggcgtgttggcgggagcctgtagtcccagctacacgggaggctaaggtgggagaattgcttgaacccgggaggcggaggttgcagtgagctgagattgcaccattgcactccagcctgggcgacagagcaagactctctcaaaaaaaaaaaaaaaagaaagaaagaaatcagaaaatcgaccacagtggtagccacctggcctaatgctgtgtttttgtacctgacaggggtcactcattttaggcacaactccttcattctttgtgaaattagtgagtttccttctacccgtcaccagattcaatatgttctattaatacaccgataaccacaggggaagggcacttgtcgctctcccacctggttaccacagtctccatgggtcttttgccgtgaccacaaataaaggaaacactcatcactagtatctaagtcgggctttacagtaactatgcaccttctgtgtgcttcacctcactctctacttcaaacagcccatggagggaggtattattatactccttatgttgacagtgaagaatctgaggcccagagaggttggggacttgagtaaagtcacacagccctgagaggcaggaccagggttccattcctgctctatccagttccaagcccttgtgttttccattatgtttagtgcctctttgctaacagcaacatctgcaagatttgtgttggttttgatggagaactctagctcatccacatgctagtgcccaagtggtggaggggccacctcagcaggtgggttctgaatgcagccaaggctgtccccgcaatgggtgagactcgctccaactgcccgccctcagagcaggtgcctaagtcctccctggcactggcaggccttacctcacattgctaaattaaagcaatgcaattcctcttgggtaagaggaattcctccttctttactaactgatccccagcaaggaaataaaatgttaggctttaaaaatccctactttgtcatatcagactatattctaaaactatatttgagcgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaacttttctactgagtgtttgcactatactttctggaatcttatttaacaaaaataaagggaaaaaattgcttgactaaa

SEQ ID NO: 105233 - DNA, 1693 bp, Homo sapiens
  Payload ID: 646
  Gene Symbol: ADCY1
  Gene Name: adenylate cyclase 1 (brain)
  ENST ID: ENST00000432715
  CDS Start-End: 380-1396
gttccactgtgcacggtggggaaactgaggctcggaggggacaaggaaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggttcagatccatccctcactgagtggcctggatgtcctcctggggttttggtctcccaccctgcaacggggacgactgtgcacgtagcttcaggtcctgcccaacagccactgtcaccagtgctgcaaggatgagctcctgccatcagcccttatcccccagggcattcacgccagctctgttcttctctcagcactctctcctgatcgtaaacataattgattatggaaaatatggagaacacaaagatgcacaagggagaaaatgaaaagcatttatctggaatcctaccatctcacaaaaaagctatcatgaacattttgttccttccagtttcttaagtttgtgtgtctgtatttttttaataaacttgactggatggta

SEQ ID NO: 105234 - DNA, 1647 bp, Homo sapiens
  Payload ID: 646
  Gene Symbol: ADCY1
  Gene Name: adenylate cyclase 1 (brain)
  ENST ID: ENST00000621543
  CDS Start-End: 335-1351
gcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtcacagccaccttggtccccgccaagcgcccacgtctctggaggacgctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggagcggctcctcatgagcctcctgccccggaacgttgccatggagatgaaggaggacttcctgaagccccctgagaggattttccacaagatttacatccagaggcacgacaatgtgagcatcctgtttgctgacatcgtgggtttcacgggcttggcatcccagtgcacagcccaggagctggtgaaactcctcaatgagctcttcggcaagttcgatgaattagccacggagaaccactgtcgccgcatcaagattctcggggactgctactactgcgtgtcgggcctcacccagcccaagactgaccatgcccactgctgtgtggagatgggactcgacatgattgataccatcacatctgtggctgaagccaccgaggtggatctgaacatgcgtgtgggtctgcacacgggcagggtcctctgtggtgtcctgggcttgcgcaagtggcagtacgacgtgtggtccaatgatgtgaccttggccaatgtcatggaagccgctggcctgccagggaaggttcatatcacaaagacgaccctagcgtgcttgaatggggactacgaggtagaaccgggttacggacatgagaggaacagtttcttgaaaactcataacatcgaaaccttttttattgtgccatcccatcgccgaaagatatttccaggcctgattctctcagatataaaaccggccaaaaggatgaagttcaagactgtctgctacctgctggtgcagctcatgcactgccggaaaatgttcaaggccgagatccccttctccaatgtcatgacctgcgaggacgatgacaaggttcagatccatccctcactgagtggcctggatgtcctcctggggttttggtctcccaccctgcaacggggacgactgtgcacgtagcttcaggtcctgcccaacagccactgtcaccagtgctgcaaggatgagctcctgccatcagcccttatcccccagggcattcacgccagctctgttcttctctcagcactctctcctgatcgtaaacataattgattatggaaaatatggagaacacaaagatgcacaagggagaaaatgaaaagcatttatctggaatcctaccatctcacaaaaaagctatcatgaacattttgttccttccagtttcttaagtttgtgtgtctgtatttttttaataaacttgactggatggt

SEQ ID NO: 105235 - DNA, 5055 bp, Homo sapiens
  Payload ID: 647
  Gene Symbol: ADCY10
  Gene Name: adenylate cyclase 10 (soluble)
  Uniprot ID: Q96PN6
  ENST ID: ENST00000367848
  CDS Start-End: 499-5055
gacagacatggcgcttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggttttactgcaatgactgagaagttcagcagtgccatgtacatggacagaggggctgagcagttggtggagatcctcaactaccacataagtgcaatagtggagaaagtgttgatttttggaggagacatcctgaaatttgcagggcaggtcaaaagcccgcggcatgtctctctctgaaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcattggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggtgtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaactgaagaaaagcttatcttgtccaactcagagattcctgagacatctgcattttttcctgaaaatcgcagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaa

SEQ ID NO: 105236 - DNA, 5051 bp, Homo sapiens
  Payload ID: 647
  Gene Symbol: ADCY10
  Gene Name: adenylate cyclase 10 (soluble)
  Uniprot ID: Q96PN6
  ENST ID: ENST00000367851
  CDS Start-End: 186-5018
gacagacatggcgcttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggttttactgcaatgactgagaagttcagcagtgccatgtacatggacagaggggctgagcagttggtggagatcctcaactaccacataagtgcaatagtggagaaagtgttgatttttggaggagacatcctgaaatttgcaggtgatgcactgctagccctgtggagggtggagcgaaagcagctgaaaaacattatcacagtggtaattaaatgtagcctggagatccatggattgtttgagacccaggagtgggaagaaggcctagacatccgagtcaagataggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcattggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggtgtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaactgaagaaaagcttatcttgtccaactcagagattcctgagacatctgcattttttcctgaaaatcgcagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcacta

SEQ ID NO: 105237 - DNA, 4966 bp, Homo sapiens
  Payload ID: 647
  Gene Symbol: ADCY10
  Gene Name: adenylate cyclase 10 (soluble)
  Uniprot ID: Q96PN6
  ENST ID: ENST00000545172
  CDS Start-End: 303-4676
agtgccacccaatcagaaacatggtcggtgcccgtggaacaatgagctactgatgagggtgtggcctggaaaacggcttttagacaaaactgtcattttatgggtcagctatagacagacatggcgcttcagctgtcttcagaataatgtcacccggcctcctctcctgtcttctgcagtcttaaaagacctagtccctaactgaggtctggcttttcctcagccctggatgaagtggagaagtgttgatttttggaggagacatcctgaaatttgcaggactggctgctggccacatcagcatgttggtctttggagatgaaacacacagccactttctggtgattggtcaggcagtggacgatgtgcgccttgcccagaacatggctcagatgaatgatgttattctgtcaccaaactgctggcagctctgtgaccggagcatgattgaaattgagagtgttccagatcagagagcagttaaggttaacttcttaaaaccaccccccaattttaattttgatgaatttttcacaaagtgtacgaccttcatgcattattatccttctggtgagcacaaaaacctcctgaggcttgcatgcacgctgaagcctgatcctgaactggagatgtccctacaaaagtatgtgatggaaagcattttgaagcagattgataacaaacagcttcagggctatttatctgagcttcgcccagtgacgattgtgtttgtgaacctgatgtttgaagaccaagacaaagcagaagagataggcccagccatccaggatgcctatatgcacatcacttctgtcctgaagatcttccaaggccaaatcaataaagtcttcatgtttgacaagggctgctctttcctctgtgtctttggcttccctggggaaaaggtacctgacgagctcactcatgctctggaatgtgctatggatatatttgacttctgctctcaagtccacaaaatccaaactgtatccatcggtgttgccagtgggattgtcttctgtgggatcgttggacacactgtgagacacgagtacacagtcattggtcaaaaagtcaacttagctgccaggatgatgatgtactacccaggaattgtgacctgcgactctgtcacctacaatgggagcaacctaccagcgtacttttttaaagagcttccaaagaaagttatgaaaggtgttgcagattctggaccattgtatcagtattggggccgtactgagaaagtcatgtttggtatggcgtgcctcatctgcaacagaaaggaggattaccctttgctgggacgtaataaagagatcaactacttcatgtatactatgaagaaatttttgatatctaacagcagccaagtcttaatgtatgagggattaccaggatatggaaaaagccagatacttatgaaaattgagtacctggcccaaggtaagaatcacaggattattgccatttcattgaataagatcagcttccatcaaactttctataccatccagatgttcatggccaatgtcctaggcctagacacttgtaaacattataaagaacgacagaccaaccttcgaaataaagtcatgacactgttggatgaaaagttctactgtcttcttaatgacattttccatgttcagttccctatttctcgggagatttccaggatgagcaccttgaaaaagcaaaaacaattggaaatattgtttatgaagatcttgaagctgatagtgaaagaggaaaggattatttttatcattgatgaggcccagtttgtggattcgacctcctggagatttatggagaagcttatccggactcttcctatcttcatcattatgtccctgtgtcccttcgttaacattccctgtgcagctgccagggccgtaataaagaacaggaacaccacctacattgtcattggtgcagtacagcctaacgacatctccaacaagatctgtcttgacctcaatgtgagctgcatctccaaagaactggactcgtacctgggggagggaagctgtgggattccattttactgtgaagaattgcttaaaaacctggaacatcatgaggtactcgttttccaacaaacggagtctgaggaaaagacaaataggacctggaataacctgttcaagtattccattaagctaacagagaagttaaacatggttactctccatagtgataaggaaagtgaagaagtctgtcacctcacaagtggtgtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaactgaagaaaagcttatcttgtccaactcagagattcctgagacatctgcattttttcctgaaaatcgcagtcctgaagaaataagagaaaagatcttgaatttctttgaccacgttttaacaaaaatgaagacatctgacgaagacattatccctctggaatcttgccagtgtgaagaaatcctagagattgtcatcttgcctctggcccaccattttctggctttgggagaaaatgacaaagccttatattacttcttagaaattgcatctgcttatctcatcttttgtgataactacatggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcactatgtccttgtgattatctattattgacctttctccgtggctggcccactccaggttcctacataatctcttctgttccagacacagaaacagacatgttgatttcttctctttctggagggcctacaagggtcaggagtgtcatggtttacttcttcctaatgttacaaaaaattgcttttaccattcatgttgttttagcttgacctgtttatttcagcccatgcaaaactgtatcatattacaaattattaatctc

SEQ ID NO: 105238 - DNA, 703 bp, Homo sapiens
  Payload ID: 647
  Gene Symbol: ADCY10
  Gene Name: adenylate cyclase 10 (soluble)
  ENST ID: ENST00000476818
  CDS Start-End: 173-394
cttcagctgtcttcagaataatgtcacccggcctcctctcctgtcttctgcagtcttaaaagacctagtccctaactgaggtctggcttttcctcagccctggatgaagtggagaagacctatttggagactgcttcctgtcaccataaaatcctgaacatttgtcttgaacatgaacactccaaaagaagaattccaggactggcccatagtcagaatagcagctcatttaccagacctcattgtctatggacatttctccccagagcgaccctttatggattattttgacggagtcctgatgtttgttgatatttcaggcaagtgcaaaagggatgtttgtttaatgtggatgagcaacaggctcgcgtgggaattcacatgcagagcttgattgcagagtagggaggccattctggagcccttgggctgtcacagcagatgtgctccactgagaacacaagagggaggaaatagcttgtggccctggctctctctcatcctcccttactcaggactgccagtcataggcatatctttaacatgctcaagtcccattctttgctccagtatctctgccccaacttcactgactcatcctctccagccccaagccccatacacatcccagtcaaaattgacctcaggaaatgatctccctagatgatgtttacatcttactaataaacttgccacctcttca

SEQ ID NO: 105239 - DNA, 2553 bp, Homo sapiens
  Payload ID: 647
  Gene Symbol: ADCY10
  Gene Name: adenylate cyclase 10 (soluble)
  ENST ID: ENST00000485964
  CDS Start-End: 1-752
agtattccattaagctaacagagaagttaaacatggttactctccatagtgataaggaaagtgaagaagtctgtcacctcacaagtggtgtcagactgaaaaacctgtcacctccaacgtcattaaaagaaatctctctgatccagctggatagcatgagactttcccaccaaatgctggtgagatgtgctgccatcattggcctgaccttcaccactgagttgttgtttgagattctcccctgttggaatatgaagatgatgatcaagaccctggcaaccctagtggaatctaacattttttattgtttccggaatggcaaggagcttcaaaaggccctgaaacagaatgatccctcatttgaggtgcactatcgttccttgtctctgaagcccagtgaagggatggatcacggtgaagaggaacagcttcgtgaactggagaatgaggtgatcgagtgccacaggattcgattctgtaaccctatgatgcagaaaacagcctacgagctgtggctcaaggaccagagaaaagccatgcacttgaaatgtgcccgctttttagaagaagatgcccacagatgtgaccactgccgaggcagggacttcattccctatcatcacttcacagtgaatattcggctcaacgctttagacatggatgccattaaaaagatggctatgtctcatggatttaaaagatgcatgagactgggagatactgcctcaccttattatattcttcaagtctgatcttaccttggtgtgcacacgtgctaagatttgcctaatgatgttgggaggtgaagctgaagtgatgagagttgtgcagggacttacttcctcatccacctcccaaaatgaccctggcaaaggaagtgggggtgattcataattcatttaaaaactgaagaccaacttctcacagatgtggggatgctgttcaaggcatacatgtatttgaatgaaggacagaagttgctaaaaactctcaagaaggacaaatcttggagccagacatttgagtctgccaccttttacagcctcaaaggtgaggtctgtttcaatatgggccagatagtgcttgccaagaaaatgctgaggaaggcactgaagctcctcaaccgaatctttccttacaacttaatctccttgtttctccatatccatgtcgagaaaaacagacactttcattatgtgaatcggcaggcccaagagagcccacctccagggaagaagaggctggcacaactttaccggcaaactgtctgcctttccttgctgtggcgcatctatagctacagttatctttttcactgcaagtattatgcccacctggcagttatgatgcaaatgaatactgcactggaaactcaaaattgtttccagatcattaaggcttacctagactattcgctataccaccacctggctggctacaaaggtgtgtggttcaaatatgaagtcatggccatggagcacatcttcaacctccccctgaaaggcgagggcattgaaatcgtggcatacgtggctgagacactggtcttcaacaagctcataatgggacacctggatttggccattgagttaggctcccgagcccttcagatgtgggcactgctccagaatcccaaccgacattatcagtccctctgcagacttagcagatgtctccttctgaacagcagatacccgcaattgatccaggtgctggggcggctgtgggagctttctgtaacacaggaacacatcttcagcaaggcatttttctattttgtctgcttggacatcctgctttattctggttttgtttatagaacatttgaagaatgtttggaattcatacaccaatacgaaaacaacagaatcctcaagttccacagtggactcctcctgggactttattcctctgtagctatctgggagtgtgaagcaggggtaggcaggagactacacacttccagagacccaggtatgccagacttcaggaatgggacaacttttacaaattttccaatagagctaaaaatcttttgccaagaagaaccatgacacttacttactatgacggaatatctaggtacatggaggggcaagttcttcaccttcaaaaacaaatcaaagaacagtcagagaatgcccaagccagtggggaggagctactcaagaacttggagaatctggtggctcaaaataccactggccctgtcttttgcccaaggctctaccacctgatggcttacgtctgtatattaatgggagatgggcagaaatgtggcctcttcctgaacacagccttgcggctctctgaaacacaggggaatatactggagaaatgctggctgaacatgaacaaagaatcatggtactcaacctctgagttaaaagaagaccaatggcttcagacgatcttgagtctcccatcatgggaaaaaattgtagcaggcagggtaaacattcaggatcttcaaaaaaacaaattcctgatgagagctaataccgtggacaatcatttctaacatgtcaaagaaaaaagattttaataagcact

SEQ ID NO: 105240 - DNA, 6575 bp, Homo sapiens
  Payload ID: 648
  Gene Symbol: ADCY2
  Gene Name: adenylate cyclase 2 (brain)
  Uniprot ID: Q08462
  ENST ID: ENST00000338316
  CDS Start-End: 90-3365
aggcggcgcgggggtgggacgcgggcggccgcggcgagcggcgctgcccgggccgggcgcgcacggcgggcgccctgtgagcggccccgatgtggcaggaggcgatgcggcgccgccgctacctgcgggaccgctccgaggaggcggcgggcggcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggaagttgaagaccatgtggcgtttctaataacagttccaactgccctggcgattttctttgcgatatttatcctggtctgcatcgagtctgtgtttaagaagctgctgcgcctcttctcgttggtgatatggatatgccttgttgccatgggatacctgttcatgtgttttggaggcaccgtctctccctgggaccaggtatcgttcttcctcttcatcatcttcgtggtgtacaccatgctgcccttcaacatgcgagacgccatcattgccagcgtcctcacctcctcctcccacaccatcgtgcttagcgtctgcctgtctgcaacaccgggaggcaaggagcacctggtctggcagatcctggccaatgtgatcattttcatctgtgggaacctggcgggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttgatttacagtgcctgtatcttttattttcctgtcttctttctcctgtggtttgctccagaattaaggtttgttttccatccattctcccttttgacacagttgtttcagaaagagctctccagaagccaatattgagatgtaattcagattaggacacagtgtgtgacgcagataactggttactcagctccctggaaagcaggcaagcatgttgaatgtatctagtggtctgattttaatttgggcatctctagagaacgctttcagggaaaaatactttaatagtaaaaagattctctgcgagcaacagtgccccctccgtccactacgctcctgtctccaagaatgttttgctagagctaacagacatagactgcaaaagaataatttggaatcagctatgcaaatcagtctcacaatagcgtgagctaactgagagaagtactaagacccacaaactgcctgttaagtctgagaaggctaaagaagacacacagccaacgttcatgcatttttaaagacagaaggccttgaagaatttgttcttgtaaatccaacacaagttgtttggtacttttaacataaagaaatcatactttgccaaatagtgaaaagtagagcaatcgtgtataagctaatgtttaaaagcaaaactgcaaattgtagcccagttggtcaaacttgttttctttttataactcatggcaggcatctgtaagaagtagagaacccagatgatctcttaggaagccttttattcgtgggaactcgaacttgaagcacaagttcctggtttgaatcctggctctgattttttactggctgtgtgactttgaacacatctcttagtccctcttaggagtactttccttattggcaacttatggactcgctagtgattaaacgaggcaatgactgtgagcgagcctggcaggtgccccgtggtacattcacagcacgggcacagctgctgtgccaggactgtgactcattcccagtaaaaggcacttatcgaagctgataaccgtccttcatcaccgaagtgtgagtagagcatgacttatttagtattctgcctcaatggggaattttttgatcctgtaatcacaactcagcattggccttaatatacctaaatctccaaaaacagtgattaaagcaagagaattattacaagggcttttctctttcctctaactcattcttcacggatgccgtagcgtttccgtgagctcaaactggccttggtgtaaaatgtgtaaggatgagcagcaggcgtgcctcgtgggttcttcctctgttacatcctgctacactcatccgcaggtcaccttagttcacctaccctgagtgaacacccccagctgggtggtccaccaagttctcataaacagagtccctcccattcccccacggggtgcaccgaacttgggtttgcgctaaaaagaactcaaaaggagaactgtgctctcccaaagccatatcaccagtcttaccaaacaataggcttttaaaagcattgagtcattgtcagaatccactatgggaagctctgtgtgtacctggtcccttctaggtgtggtcccataggagcagccttagcatcccctgtgaacttatcaaaaatgcaaattctcaggccccaacctgaaggaggaccctgaatttgagatccccggggctggggcccagcacaactgctgtttagtgaacaggttctccaggtgattctgatccctgatcaagcttcagacctccctccctccccagtgtttttgcaggtgaggaaacaggggcagagtaattcaggcacatgtgttcagagttccacagttgattagcagttgaggccaggctagaatggaaaactgcctgttccttgaatctgaaagagcattattcctggtcaaagctccttaaagttctgggcagctaaaagcatccctgtgagcaaaaatgccaggcagaaaactggcagtgcacctctcatcagcccaggtcccagtgccattggcttcaagaaaaaaaaaaaatctctccccaatgctctccttaacctttaagtcttacaggaagcctctcatagaaattgcctccagtccagtttcccaaaaaccccagtgttttacatatctgtttaggagtgtctaagttttgtcatcaatccaggatgttattcttccttcccaactcactgtgctcctaaaggcagcaaccattcatctttcctttgctctggatacaccgaatgaccaggtaacatcatcaggccgggtgcagtggctcctataatcccaatattttgggaggccgaggagagaggatcacttaagcccaggagtctgagaccagcctgggcaacatagcaagacccccatctctgcaaaaaaataagaaaattagcttggcatggtggcacgtgcctgtagtcccagctacatgggaggctgaggtgggaggatcacttgagcccaggaagtccagaacgtagtgagccttgattataccactgcactccagcctgggtgacagagcgagactctgtctcag

SEQ ID NO: 105241 - DNA, 431 bp, Homo sapiens
  Payload ID: 648
  Gene Symbol: ADCY2
  Gene Name: adenylate cyclase 2 (brain)
  ENST ID: ENST00000515681
  CDS Start-End: 131-431
gcattctgtatctctcctctttccagtataaagatgagttatgaggacactctctctcctttaaactatcctggccaatgtgatcattttcatctgtgggaacctggcgggagcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactag

SEQ ID NO: 105242 - DNA, 756 bp, Homo sapiens
  Payload ID: 648
  Gene Symbol: ADCY2
  Gene Name: adenylate cyclase 2 (brain)
  ENST ID: ENST00000493243
  CDS Start-End: 1-230
tcctgggcgactacagccaggtcttatttgagagaccaggcatttggaaagacctgaagaccatgggctctgtgtctctctctatattcttcatcacactgcttgttctgggtagacaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacag

SEQ ID NO: 105243 - DNA, 3956 bp, Homo sapiens
  Payload ID: 648
  Gene Symbol: ADCY2
  Gene Name: adenylate cyclase 2 (brain)
  ENST ID: ENST00000537121
  CDS Start-End: 27-3296
cggcgggcgccctgtgagcggccccgatgtggcaggaggcgatgcggcgccgccgctacctgcgggaccgctccgaggaggcggcgggcggcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggaagttgaagaccatgtggcgtttctaataacagttccaactgccctggcgattttctttgcgatatttatcctggtctgcatcgagtctgtgtttaagaagctgctgcgcctcttctcgttggtgatatggatatgccttgttgccatgggatacctgttcatgtgttttggaggcaccgtctctccctgggaccaggtatcgttcttcctcttcatcatcttcgtggtgtacaccatgctgcccttcaacatgcgagacgccatcattgccagcgtcctcacctcctcctcccacaccatcgtgcttagcgtctgcctgtctgcaacaccgggaggcaaggagcacctggcagatcctggccaatgtgatcattttcatctgtgggaacctggcggggcctaccataagcacctcatggaactcgctcttcagcaaacatatcaggacacctgtaattgcatcaagtcgcggatcaagttggaatttgaaaaacgtcaacaggagcggcttctgctctccctgctgccggcccacatcgccatggagatgaaagcggagatcatccagaggctgcagggccccaaggcgggccagatggagaacacaaataacttccacaacctgtatgtgaagcggcatacaaacgtgagcatcttatacgctgacatcgttggctttacccggctggcaagtgactgctccccgggagaactagtccacatgctgaatgagctctttggaaagtttgatcaaattgcaaaggagaatgaatgcatgagaattaaaattttaggagactgctactactgtgtatctggactccctatatctctccctaaccatgccaagaactgtgtgaaaatggggctggacatgtgtgaagccataaagaaagtgagggatgctactggagttgatatcaacatgcgcgtgggcgtgcattctgggaatgtcctgtgtggcgtgattggtctgcagaagtggcaatatgatgtgtggtcacatgatgtgaccttggccaaccacatggaagctggaggggtccctggacgtgttcacatttcttctgtcaccctggagcacttgaatggcgcttataaagtggaggagggagatggtgacattagggacccatatttaaaacagcacctggtgaaaacctactttgtgatcaaccccaagggagaacgacggagcccccagcatctcttcagacctcgccacacccttgatggagccaaaatgagggcctcggtccgcatgacccggtacttggagtcctggggggcagccaagccctttgcacacctacatcacagggacagcatgaccacagagaacggcaagatcagcaccacggatgtacccatgggtcagcataattttcaaaatcgcaccttaagaaccaagtcacaaaagaagagatttgaagaagaattgaatgaaaggatgattcaagcaattgatgggattaatgcacagaagcaatggctcaagtctgaagacattcagagaatctcactgcttttctataacaaagtactagaaaaagagtaccgggccacggcactgccagcgttcaagtattatgtgacttgtgcctgtctcatattcttctgcatcttcattgtgcagattctcgtgctgccaaaaacgtccgtcctgggcatctcctttggggctgcgtttctcttgctggccttcatcctcttcgtctgctttgctggacagcttctgcaatgcagcaaaaaagcctctcccctgctcatgtggcttttgaagtcctcgggcatcattgccaaccgcccctggccacggatctctctcacgatcatcaccacagccatcatattaatgatggccgtgttcaacatgtttttcctgagtgactcagaggaaacaatccctccaactgccaacacaacaaacacaagcttttcagcctcaaataatcaggtggcgattctgcgtgcgcagaatttatttttcctcccgtactttatctacagctgcattctgggactgatatcctgttccgtgttcctgcgggtaaactatgagctgaagatgttgatcatgatggtggccttggtgggctacaacaccatcctactccacacccacgcccacgtcctgggcgactacagccaggtcttatttgagagaccaggcatttggaaagacctgaagaccatgggctctgtgtctctctctatattcttcatcacactgcttgttctgggtagacagaatgaatattactgtaggttagacttcttatggaagaacaaattcaaaaaagagcgggaggagatagagaccatggagaacctgaaccgcgtgctgctggagaacgtgcttcccgcgcacgtggctgagcacttcctggccaggagcctgaagaatgaggagctataccaccagtcctatgactgcgtctgcgtcatgtttgcctccattccggatttcaaagaattttatacagaatccgacgtgaacaaggagggcttggaatgccttcggctcctgaacgagatcatcgctgactttgatgatcttctttccaagccaaaattcagtggagttgaaaagattaagaccattggcagcacatacatggcagcaacaggtctgagcgctgtgcccagccaggagcactcccaggagcccgagcggcagtacatgcacattggcaccatggtggagtttgcttttgccctggtagggaagctggatgccatcaacaagcactccttcaacgacttcaaattgcgagtgggtattaaccatggacctgtgatagctggtgtgattggagctcagaagccacaatatgatatctggggcaacactgtcaatgtggccagtaggatggacagcaccggagtcctggacaaaatacaggttaccgaggagacgagcctcgtcctgcagaccctcggatacacgtgcacctgtcgaggaataatcaacgtgaaaggaaagggggacctgaagacgtactttgtaaacacagaaatgtcaaggtccctttcccagagcaacgtggcatcctgaagagtcaccttcattttggcaagaagactgtattttcaggaaggtatcacacactttctgactgcaacttctgtcccttgtttttgatgtgcgtgctgtctgtcctatggagcctctgcagactcgttctcgtgacccagtggcataccgtttggtgtctgatgtgtgcccagatcgttctgccacttgcactgtgcttgctcctaagcaaaagggaaaaggagcgcgcgtgatagaagaaaagcactgggagaactaacagaggagaaaggtgaaacacacacacattcttaaggcaataaaactagggggtgtatattatcttctggtgcatgttcttttctggaaaatatggtagctcgccaaccgcatctgctcatctgatattcaaacacacagtattcgtgaataagttgattctgtcccccacgtggactctgtgctcacccattgtctcattgccagtggtgtccaagggcccccgttgggacccacggctctcgtccctctgctccgtgtgtctcatgccagcagcacgtcgccatccgtcaccagaattagtcctcacagcctaggaccagttttgtatcaaactcgtctgatgttttgatgccatttgtcttttgtaaagttaattcattaaaagttttatgtactttg

SEQ ID NO: 105244 - DNA, 5050 bp, Homo sapiens
  Payload ID: 649
  Gene Symbol: ADCY3
  Gene Name: adenylate cyclase 3
  Uniprot ID: O60266
  ENST ID: ENST00000260600
  CDS Start-End: 853-4287
cgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacaggtaaacgcaggggcagggccaggcttccgggggggaagacagcgccccgagcgtgggaagggggccggatcggagcccgagcctccaagggtttggtggaaaaaggaagtaaacagaaggaaggctcaggaatcccccacgatggtcctgatttctttccggcacattttatttacagcttctaaggactgggcctggagggaatttaggtgaggaagtcggggactgagaaagaagagatgacagagagaaaccggttaccagggatggaaaggcggctaggcccttccacaagccagggacaggaaattgagtgtctggcgtggacaggactaagtgtgcctgcggtgggcggtggtgtgagccgggggtggcagggaaggccctgggttgggaggctcttgcagcagagatccttttatgagggttagggcgggtcatggggaaaccgcaaggtaggagggaagaggtgcttctactcagcaatgcccttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaa

SEQ ID NO: 105245 - DNA, 4397 bp, Homo sapiens
  Payload ID: 649
  Gene Symbol: ADCY3
  Gene Name: adenylate cyclase 3
  ENST ID: ENST00000405392
  CDS Start-End: 200-3637
agttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacagcaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttg

SEQ ID NO: 105246 - DNA, 1801 bp, Homo sapiens
  Payload ID: 649
  Gene Symbol: ADCY3
  Gene Name: adenylate cyclase 3
  ENST ID: ENST00000435135
  CDS Start-End: 355-1801
cgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaagg

SEQ ID NO: 105247 - DNA, 894 bp, Homo sapiens
  Payload ID: 649
  Gene Symbol: ADCY3
  Gene Name: adenylate cyclase 3
  ENST ID: ENST00000427849
  CDS Start-End: 1-894
tgcgccatcgctgtgggcatcatgtcctactacatggctgaccgcaagcaccgcaaggccttcctggaggcccgccagtcgctggaggtgaagatgaacctggaagagcagagccagcagcagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtggg

SEQ ID NO: 105248 - DNA, 561 bp, Homo sapiens
  Payload ID: 649
  Gene Symbol: ADCY3
  Gene Name: adenylate cyclase 3
  ENST ID: ENST00000433852
  CDS Start-End: 98-561
tgtcaccacagagcctgatcgtgctgtgcagtctaaaggggaccacggggcaagaagaggtgactttggtggtgtccagagcaggcttctcaacctcatgggtttgatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggagaacctcatgctttccatcctgcccaagcacgtggctgacgagatgctgaaagacatgaagaaagacgagagccagaaggaccagcagcagttcaacaccatgtacatgtaccgtcacgagaacgtcagcatcctctttgccgacatcgtgggctttacccagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcc

SEQ ID NO: 105249 - DNA, 595 bp, Homo sapiens
  Payload ID: 649
  Gene Symbol: ADCY3
  Gene Name: adenylate cyclase 3
  ENST ID: ENST00000455323
  CDS Start-End: 1-595
gtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatgctcagctgtctccagtactacacgggacccagcaatgcaacggcagggatggaaacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacagcaggctgcccctggtgccttccaagtactctatgacggtgatggtgttcctcatgatgctcagcttctactacttctcccgcc

SEQ ID NO: 105250 - DNA, 572 bp, Homo sapiens
  Payload ID: 649
  Gene Symbol: ADCY3
  Gene Name: adenylate cyclase 3
  ENST ID: ENST00000438445
  CDS Start-End: 237-572
atttacagcttctaaggactgggcctggagggaatttagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctgga

SEQ ID NO: 105251 - DNA, 3136 bp, Homo sapiens
  Payload ID: 649
  Gene Symbol: ADCY3
  Gene Name: adenylate cyclase 3
  ENST ID: ENST00000606682
  CDS Start-End: 1-2376
cagctgtcttctgcctgcagtgcccaggagcttgtgaagctgctcaacgagctctttgcccgctttgacaagctggcagctaaataccaccagctgcggattaagatcctgggcgactgctactactgcatctgcggcttgcccgactaccgggaggaccacgccgtctgctccatcctcatggggctggccatggtggaggccatctcgtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctggcggatcaaagattgaagaaagattgtactcctgtgtcgtggctccaacactgaggctgagatgggagcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggccctgcccaatggagcaccagcttcctcaaagtccagctcccctgccctcattgagaccaaggagcccaacgggagtgcccacagcagtgggtccacgtcggagaagcccgaggagcaggatgcccaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggctaatgacaaactatgtgaccttcatggtgggggagattctgctcctcatcctgaccatctgctccctggctgccatctttccccgggcctttcctaagaagcttgtggccttctcaacttggattgaccggacccgctgggccaggaacacctgggccatgctcgccatcttcatcctggtgatggcaaatgtcgtggacatggtcagccacatggtgaagctcacgctcatgctgctcgtcgcaggcgccgtggccaccatcaacctctatgcctggcgtcccgtctttgatgaatacgaccacaagcgttttcgggagcacgacttacctatggtggccttagagcagatgcaaggattcaaccctgggctcaatggcactgacaggctgcccctggtgccttccaagtactctatgacggtgatggtgttcctcatgatgctcagcttctactacttctcccgccacgtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggagctgtatagccagacgtatgatgagattggagtcatgtttgcctccctgcccaactttgctgacttctacacagaggagagcatcaacaatggtggtattgagtgtctgcgtttcctcaatgaaatcatctcagattttgactctctcctggacaatcccaagttccgggtgatcaccaagatcaaaaccattggcagcacgtatatggcggcttcaggagtcacccccgatgtcaacaccaatggctttgccagctccaacaaggaagacaagtccgagagagagcgctggcagcacctggctgacctggccgacttcgcgctggccatgaaggatacgctcaccaacatcaacaaccagtccttcaataacttcatgctgcgcataggcatgaacaaaggcggggttctggctggggtcatcggagcccggaaaccacactacgacatctggggcaatacagtcaatgtagccagcaggatggagtccacgggggtcatgggcaacattcaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttg

SEQ ID NO: 105252 - DNA, 887 bp, Homo sapiens
  Payload ID: 649
  Gene Symbol: ADCY3
  Gene Name: adenylate cyclase 3
  ENST ID: ENST00000498288
  CDS Start-End: 1-148
ctacgacatctggggcaatacagtcaatgtagccagcaggatggagtccacgggggtcatgggcaacattcagtggcgtctggcagaaaagctccacgaaaggggcaaagggacagaagagcaggcagtggcagtttccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctgtgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcagggg

SEQ ID NO: 105253 - DNA, 3415 bp, Homo sapiens
  Payload ID: 650
  Gene Symbol: ADCY4
  Gene Name: adenylate cyclase 4
  Uniprot ID: Q8NFM4
  ENST ID: ENST00000310677
  CDS Start-End: 115-3348
agagcgcagcggcgagcgtgactccgccatcaggtccccggctccctccccggacctagcccactccgctgcgccagcgccgcgggcaccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccattgatgtctg

SEQ ID NO: 105254 - DNA, 3353 bp, Homo sapiens
  Payload ID: 650
  Gene Symbol: ADCY4
  Gene Name: adenylate cyclase 4
  Uniprot ID: Q8NFM4
  ENST ID: ENST00000418030
  CDS Start-End: 96-3329
gcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacc

SEQ ID NO: 105255 - DNA, 3385 bp, Homo sapiens
  Payload ID: 650
  Gene Symbol: ADCY4
  Gene Name: adenylate cyclase 4
  ENST ID: ENST00000554781
  CDS Start-End: 96-1445
gcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggttcctctgcacacccacatacacactcccaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacc

SEQ ID NO: 105256 - DNA, 3990 bp, Homo sapiens
  Payload ID: 650
  Gene Symbol: ADCY4
  Gene Name: adenylate cyclase 4
  ENST ID: ENST00000557056
  CDS Start-End: 365-1015
agagcgcagcggcgagcgtgactccgccatcaggtccccggctccctccccggacctagcccactccgctgcgccagcgccgcgggcagagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccagccccacttgggccttcggcttcccgcgccccgcccccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccagtgagtgttcccacatgcccttaatctccttctgcacacccttcctcagcccaagcccacagccccctgagtggaggaacgctccattctgtggattagaacagacataagtcacacccagtgtgtatcagtgtgtatgatgccccctgtctcccagataggacctgggcctgggagggacaggaagggagccctcaggtgtcccccctctgcctatgggacatgcccactcctgacccctgcctggccccacagtactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggtgtgcacagctgctggacagaggtgccgggccccctgggatggggtgagatgggatacagcagagctgtcctggcctcaccgacctgaatcacccacagggcaaagtgggagggaagcggaggcctacatgggggcagggagaaggccaggaagggggaaagcaaggggtcaccctgatccatggccccttcaggcccggagtgctgaaggagcccaaactgatgggtgctatctccttcttcatcttcttcttcaccctccttgtcctggctcgccaggtaagtcacccagctcagccccaccagggcccacctatgagtggcccccatatctgtgacttgatctttctaatctccagggttgaatgcccattggaagcttctaagcgagccttcctgcttcctttcttctccttcactccctgcccctcctttctcccacacccctatctgggaaagcccatgctttagaaaaagtctgctgccaattctctatccctagtctgaatctaatttcaaggatagtctctctccaagtatacttacaccttaagctctacttctaaactgggggtggggtgggggtggtttcaggcatcatggagttggggctgaacactcaggagctgggcttcccctgctctgtgtctccccatggccccgggtgaccctccccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggagcccattgatgtctg

SEQ ID NO: 105257 - DNA, 411 bp, Homo sapiens
  Payload ID: 650
  Gene Symbol: ADCY4
  Gene Name: adenylate cyclase 4
  ENST ID: ENST00000556932
  CDS Start-End: 1-411
gcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccagacagtggaagcagtcgaaggacttcaacccactgacactgtacttcagagagaaggagatggag

SEQ ID NO: 105258 - DNA, 3404 bp, Homo sapiens
  Payload ID: 650
  Gene Symbol: ADCY4
  Gene Name: adenylate cyclase 4
  Uniprot ID: Q8NFM4
  ENST ID: ENST00000554068
  CDS Start-End: 119-3352
agagcgcagcggcgagcgtgactccgccatcaggtccccggctccctccccggacctagcccactccgctgcgccagcgccgcgggcaccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcctgcactgctgccgcagttggcagcaaacgcagtgctgttcctgtgcgggaacgtggcaggagtgtaccacaaggcgctgatggagcgcgccctgcgggccacgttccgggaggcactcagctccctgcactcacgccggcggctggacaccgagaagaagcaccaggaacaccttctcttgtccatccttcctgcctacctggcccgagagatgaaggcagagatcatggcacggctgcaggcaggacaggggtcacggccagagagcactaacaatttccacagcctctatgtcaagaggcaccagggagtcagcgtgctgtatgctgacatcgtgggcttcacgcggctggccagcgagtgttcccctaaggagctggtgctcatgctcaatgagctctttggcaagttcgaccagattgccaaggagcatgaatgcatgcggatcaagatcctgggggactgttactactgtgtctctgggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggttgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctgga

SEQ ID NO: 105259 - DNA, 575 bp, Homo sapiens
  Payload ID: 650
  Gene Symbol: ADCY4
  Gene Name: adenylate cyclase 4
  ENST ID: ENST00000559167
  CDS Start-End: 468-575
agagcgcagcggcgagcgtgactccgccatcaggtccccggctccctccccggacctagcccactccgctgcgccagcgccgcgggcacccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcgcctgggaccaggtgtcctattttctcttcgtcatcttcacggcgtatgccatgctgcccttgggcatgcgggacgccgccgtcgcgggcctcgcctcctcactctcgcatctgctggtcctcgggctgtatcttgggccacagccggactcacggcct

SEQ ID NO: 105260 - DNA, 559 bp, Homo sapiens
  Payload ID: 650
  Gene Symbol: ADCY4
  Gene Name: adenylate cyclase 4
  ENST ID: ENST00000561138
  CDS Start-End: 214-559
agagcgcagcggcgagcgtgactccgccatcaggtccccggctccctccccggacctagcccactccgctgcgccagcgccgcgggcagtgagttcggggatcaggggaacccggggctccctcgcaccaaccccaaatcctgccctcctggcgatgaggcttttctagggcacctctacaatccggccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggagctgacctcagacccgagcttcctgaccactgtgctgtgcgcgctgggcggcttctcgctgctgctgggcctcgcttcccgggagcagcgactgcagcgctggacgcgtcccctgtccggcttggtatgggtcgcgctgctagcgctaggccacgccttcctgttcaccgggggcgtggtgagcg

SEQ ID NO: 105261 - DNA, 2841 bp, Homo sapiens
  Payload ID: 651
  Gene Symbol: ADCY5
  Gene Name: adenylate cyclase 5
  Uniprot ID: O95622
  ENST ID: ENST00000309879
  CDS Start-End: 76-2811
tataaatgtcctagggaaggaggttattgcctttagcccctttttggggaagcgtctggaagtaagtcctgaggaatgaagtctcagaaagagggctgttgcagcagaggtgacctgtccattcagacaggtcctggaggagaatgggccccacggaggcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtgccctgagcatgcaaccaaggtggcattgaaggtggtgacgcccatcatcatctcagtctttgtgctggccctgtacctgcacgcccagcaggtggagtccactgcccgcctcgacttcctctggaaactgcaggccacagaggagaaagaggagatggaggagctgcaggcctacaaccggcggctgctgcacaacatcctgcccaaggacgtggccgctcacttcctggcccgcgagcggcgcaatgatgagctctactatcagtcctgtgagtgtgtggcggtcatgttcgcctccatcgccaacttctccgagttctacgttgagctggaggccaacaacgagggtgtcgagtgcctgcggctactcaatgagatcatcgctgactttgatgagatcatcagcgaggatcggttccggcagctggagaagatcaagaccatcggcagcacctacatggctgcctccggcctcaacgactctacctacgacaaggtgggcaagacccacatcaaggcactggccgactttgccatgaagctgatggaccagatgaagtacatcaatgagcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcct

SEQ ID NO: 105262 - DNA, 580 bp, Homo sapiens
  Payload ID: 651
  Gene Symbol: ADCY5
  Gene Name: adenylate cyclase 5
  ENST ID: ENST00000476455
  CDS Start-End: 190-426
gtcttatgttctcagcactcggggtgcttgtcaaccagccttttggtctgcatttgaaagtccccttccagagcctcgaggcaatctctggggcccctggatccctgctgaggtgcccatggtcccctccatccccacagggcagcctgtgtagtgctgggtagggcccaggcctgtcccacggaagacatggccccatctaggttccgcactcagttggaggtaagcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacga

SEQ ID NO: 105263 - DNA, 3962 bp, Homo sapiens
  Payload ID: 651
  Gene Symbol: ADCY5
  Gene Name: adenylate cyclase 5
  ENST ID: ENST00000491190
  CDS Start-End: 539-3298
agatgcatggagggcctggaatcatgatgaggggaggggatgcggtgctctctcgggcaccggctgcactatcagcgttccctggagaaacagaacccttaggatttatatagacatatagaaagatttactgtgggggattggctcatgccgttacggagactgagaagacccatgagctgttgtctgtaagctggaggaccagaaaagccagtgacgtggtttcagtccaagcctgaaggcctgaaacccaggagagacaatgttgtaagtcccagcctaagtcagaggcctgagaaccaggagcccgctttccaagggcaggggaagatggatgtctcagctcaagaagagagtgaattctcccctcctctacctttttgctctattcaagccttcagtggatttgataacgcccacctgaatttggcaatctctggggcccctggatccctgctgaggtgcccatggtcccctccatccccacagggcagcctgtgtagtgctgggtagggcccaggcctgtcccacggaagacatggccccatctaggttccgcactcagttggagcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtggagcctgtgtgagaacctcagacacaggagaatggaagctggtacctactttccctctggagtcaaggaacaaagccctgagcatgcaaccaaggtggcattgaaggtggtgacgcccatcatcatctcagtctttgtgctggccctgtacctgcacgcccagcaggtggagtccactgcccgcctcgacttcctctggaaactgcaggccacagaggagaaagaggagatggaggagctgcaggcctacaaccggcggctgctgcacaacatcctgcccaaggacgtggccgctcacttcctggcccgcgagcggcgcaatgatgagctctactatcagtcctgtgagtgtgtggcggtcatgttcgcctccatcgccaacttctccgagttctacgttgagctggaggccaacaacgagggtgtcgagtgcctgcggctactcaatgagatcatcgctgactttgatgagatcatcagcgaggatcggttccggcagctggagaagatcaagaccatcggcagcacctacatggctgcctccggcctcaacgactctacctacgacaaggtgggcaagacccacatcaaggcactggccgactttgccatgaagctgatggaccagatgaagtacatcaatgagcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggaaaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaac

SEQ ID NO: 105264 - DNA, 7311 bp, Homo sapiens
  Payload ID: 651
  Gene Symbol: ADCY5
  Gene Name: adenylate cyclase 5
  Uniprot ID: O95622
  ENST ID: ENST00000462833
  CDS Start-End: 1214-4999
gggcgagaagggaggagcggcgcgagcggccggagcggcgcagggcccgaagcgtgcatggcgcgccctgagccgggctcccgcgggcccccccggagcgcctctcgggcgccgcggctctcaggcgggcccctctgggccggctgcttctgagccccggcgctggatctctggatgccttactccccgggagaagcctgcctgcgtcggggcagaaccgcggcagcgctgcgccggattccgtcctccgcctagtcgttccgcgccggccgcggtgggcccgcagccggcgacgaggagcttggggcttgcgaagcgggcgcgacagctctccgggccggcaggtcccggccggccccgctccgtttgcgggaaagggagaggcgagaggggaagggccgcaccgcaggagccggtccctgacccggaccccgccccctgcgcggacgcgccgaaggctcggctcggctttcgccggggccacgcatccactctcgccgcgagaggtgggggatgcgggcaacggcccccccgggctccaggaccctcccccccggggctccggagctgttgctccgcccgtcgccccctcccccgtcctctccacctcccatcccacctccccacccctcgtaagaaaataatgctggctggcgcccgcacctcccagtcgctcccagtccgctgcgaggaaagcgcacccgcagtgtctcttcgccgggacccccgccgagccgccctcgccgccgccgagccccgagagcagctgggctccgcttaggcggaatcagcgagcgccgcgcccgggcactgccggcccgaggaggcaccgcccgcaaggacaccactccgtcccgtctcgtccgcaactccggccctcgtcgagctcgacgcgagccaggatcccggacgtctctccgcgtgcggcgcagcagcagccagaccagtccctgcgaccccacctcggaggcaactccatttcggacctgggacttctgacgcggatcctcagctacttctcacctcggggctgtgccctcctcctccgctcaggacgggggtgccaagatgccccgctgcagcgcagggccccgggccgcccccgacgtgtgaccctagcctggtccccctgctcggccgtccgccctccccttggagacccccggcccggcttccgggggaggaggaaggagacgacgaggccgagggggggatgtccggctccaaaagcgtgagccccccgggctacgcggcgcagaagactgcggcgccggcgccccggggaggccccgaacaccgctctgcgtggggcgaggccgattcccgcgcgaatggctacccccatgcccccgggggctctgcccgcggctccaccaagaaacccgggggggcggtgaccccgcagcagcagcagcgcctggccagccgctggcgcagcgacgacgacgacgatcctccgctgagcggtgacgaccccctggccgggggcttcggcttcagcttccgctccaagtccgcctggcaggagcgcggcggcgacgactgcggtcgcggcagccgccggcagcggcggggcgcggccagcgggggcagcacccgggcgccccctgcgggcggcggcggcggctcggcggcggcggctgcctcggcgggcgggacggaggtgcgccctcgctcggtggaggtgggtctggaggagcggcggggcaaggggcgcgcggccgacgagctggaggccggcgccgtcgagggcggcgaggggtccggggatggcggcagctcggcggactcgggctcgggcgcggggcccggcgcggtgctgtccctgggcgcctgctgcctggcgttgctgcagatattccgctccaagaagttcccgtcggacaaactggagcggctgtaccagcgctacttcttccgcctgaaccagagcagcctcaccatgctcatggccgtgctggtgctcgtgtgcctggtcatgttggccttccacgcggcgcggcccccgctccagctgccctacctggccgtgctggcggccgccgtcggcgtgatcctcatcatggctgtgctttgcaaccgcgccgccttccaccaggaccacatgggcctggcctgctatgcgctcatcgccgtggtgctggccgtccaggtggtgggcctgctgctgccgcagccacgcagcgcctctgagggcatctggtggaccgtgttcttcatctacaccatctacacgctgctgcccgtgcgcatgcgggccgcagtgctcagcggggtgctcctgtccgccctccacctggccatcgccctgcgcaccaacgcccaggaccagttcctgctgaagcagcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctggtgctcatgctggccatcgagctcatctacgtgctcatcgtggaggtgccaggtgtcacgctcttcgacaacgccgacctgctggtcaccgccaacgccatagacttcttcaacaacgggacctcccagtgccctgagcatgcaaccaaggtggcattgaaggtggtgacgcccatcatcatctcagtctttgtgctggccctgtacctgcacgcccagcaggtggagtccactgcccgcctcgacttcctctggaaactgcaggccacagaggagaaagaggagatggaggagctgcaggcctacaaccggcggctgctgcacaacatcctgcccaaggacgtggccgctcacttcctggcccgcgagcggcgcaatgatgagctctactatcagtcctgtgagtgtgtggcggtcatgttcgcctccatcgccaacttctccgagttctacgttgagctggaggccaacaacgagggtgtcgagtgcctgcggctactcaatgagatcatcgctgactttgatgagatcatcagcgaggatcggttccggcagctggagaagatcaagaccatcggcagcacctacatggctgcctccggcctcaacgactctacctacgacaaggtgggcaagacccacatcaaggcactggccgactttgccatgaagctgatggaccagatgaagtacatcaatgagcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcctggcctccagaggcatggaagcagcttctctgtgtgccgggggtggcggggaagccatgctccagcccgcagggctgcgctgctgagattttccacttggactccagagcagcttctgcctttgctggtgggcagcggcctctgtcccaggccccggggtgccagcgtcctgcgagcacccagctgaccaaagatgtttccctctgtagaagactctgctagactgggtctgaagcttgagttttctaacaggtgctgctgcacaggtggaaaggagccgtgggaatgtgtgtgtggcacggcccagacaagggcagggctgaggggcctccgactcagctgggggtagacgggctcgaatgtggcctgggagagcctagggggccccaggggtctgcttttctatgtgagcctttaaacttcagacaggccaccaccctgcacctgcaggggctttggcacaggagtgctggctttggagggactgtggccttcatcgtggtcctctgcccacacctccacgcacacagacagtgccctaggagggaaacagaactaattacgagggggaggcaagaggacgccaagcaaggagtggtgattctgagaaaaatatttattaaataaaacaaaacaagttctccgtgcccttctttagactatgctagttgtatgcgtgtaagagacacacaagcaaacgaggacgccactcggggggagggcggggatccccacttgtcttttttgtattttttattttgtattattgaaagccttggagatctcacagatagatatgccaaattctatattttgtaaattctctatattagaaaacagctgtgcacagcagggcgggtgtgctcatttgtactgtgtgtatgtcggtgtatgtactggtgtatatgtgtgtgtgttcatgctgtggaactggtctcacacaggatgtgtttccctcatttcagatttggcagttttgggttttccaaggtaccaccagagcagtgggtgtgtgcttttggggtaccatatgctcagattaagtaggaggatgcatggacacactgccccatcttttctgacacacgcacacgtatgtacacacatgcacacaccctccttcccctaagcaaaacgcagatggaataagaaaacaaaaagctgctttcccatcccaggccgagctggaaccaagggaagcaatctcatcctgcgacaggcagtgtggtgccctccacaccctgagatttcagacgtttgcggcttacagaggcagcgcccacagattccagagtgcttacagaaggccaggtgctttgcaggctgggacgaggaagccaagcctccctggcctactcagttggccaaggtgcaggtggctcttcctggagatgttcactcagactgggggatgcaatgtgcagccttcaggtttgcggaaagggagtggccttgacctccaccggcaaaccaggcagaggaatgggtagagcccagctttagagtccacagggaaagctagcaggaattttgttttagtgggagggggcagttaaacataccaagaaaaaaatactatttttataacctatgaggaagacatttggaaaatgatactctagcacagaattcagtggaatccttagggcccatgcccaaatctttccattgcttctcaggttagaatgatcttcacctccaacatgagcttggaggtgatgaggcagtggctctgtgccagctgccacaatgtgactttgatgtccacctgtaccacctctcactgggctctagcaccaccctcccctccccgcacaccaactgaacacagctctgagaagcaaagtgtgtggacccaaaactgccaagcctgagtctgtcccgtgcttctgctgctccatcctttgagttctgcattgccatcctgacgtcggccacaggaggcctgctttcttccagctgttgttctcaagttccctgcccctccacatcgcccgccagtggtgttgggttttcgttctgcttccaacctgagtaaagtgtgtgtgctgagttcatcccatgttctcccatggtcatggcttcccggccccatggggacccctctcccatcccagcagtgactggtgacagtgtgcaggtgcagtgctagctcttcgttccctctaaagggtgtgcactctttttattcctactcttgcaaaaacagatacgattatgatttcccatggaaattgaaaagtctatttaaataatttaactattaaacactttcactggtaa

SEQ ID NO: 105265 - DNA, 1789 bp, Homo sapiens
  Payload ID: 651
  Gene Symbol: ADCY5
  Gene Name: adenylate cyclase 5
  ENST ID: ENST00000466617
  CDS Start-End: 313-1789
agctggaaagatggggcaaggcagaagctgggcctcagacacaggcaggggacatgggccgactgcccacctcctggcccctgaccatggtggagtgggaggtctggatggagcagtgagaagcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctgaccacgcccactgctgtgtggagatgggcatggacatgatcgaggccatctcgttggtccgggaggtgacaggggtgaacgtgaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaaccaactccatcgggcacaacccaccacactggggggctgagcgccccttctacaaccacctgggtggcaaccaggtgtccaaggagatgaagcggatgggctttgaagaccccaaggacaagaacgcccaggagagtgcgaaccctgaggatgaagtggatgagtttctgggccgtgccattgacgccaggagcattgataggcttcggtctgagcacgtccgcaagttcctcctgaccttcagggagcctgacttagagaagaagtactccaagcaggtagacgaccgatttggtgcctatgtggcgtgtgcctcgctcgtcttcctcttcatctgctttgtccagatcaccatcgtgccccactccatattcatgctcagcttctacctgacctgttccctgctgctgaccttggtggtgtttgtgtctgtgatctactcctgcgtaaagctcttcccctccccactgcagaccctctccaggaagatcgtgcggtccaagatgaacagcaccctggttggggtgttcaccatcaccctggtgttcctggcggcttttgtcaacatgttcacgtgcaactccagggacctgctgggctgcttggcacaggagcacaacatcagcgcgagccaggtcaacgcgtgtcacgtggcggagtcggccgtcaactacagcctgggcgatgagcagggcttctgtggcagcccctggcccaactgcaacttccccgagtacttcacctacagcgtgctgctcagcctgctggcctgctccgtgttcctgcagatcagctgcatcgggaagctgg

SEQ ID NO: 105266 - DNA, 577 bp, Homo sapiens
  Payload ID: 651
  Gene Symbol: ADCY5
  Gene Name: adenylate cyclase 5
  ENST ID: ENST00000483566
  CDS Start-End: 306-577
gtgcatgcatgtgagtgtggatagagaatgtccttcattaagctgctgtggcctcatgaccatgactcataaacttacaatcaagctctgctggacagaggagacctgtccccaggcttgtctccaatgttctcattttctcctgcaccaacatcgtgggtgtctgcacccactatccggctgaggtctcccagagacaggctttccaggagacccgagagtgcatccaggcgcggctccactcgcagcgggagaaccagcagcaggaacggctcctgctgtctgtccttccccgtcatgttgccatggagatgaaagcagacatcaacgccaagcaggaggatatgatgttccataagatttacatccagaaacatgacaacgtgagcatcctgtttgctgacatcgagggcttcaccagcctggcgtcccagtgcactgcacaggaactggtcatgaccctcaacgagctcttcgcccgctttgacaagctggccgcagagaatcactgtttacgtattaagatccttggggattgttattactgcgtctcggggctgcctgaagcaagggctga

SEQ ID NO: 105267 - DNA, 6464 bp, Homo sapiens
  Payload ID: 652
  Gene Symbol: ADCY6
  Gene Name: adenylate cyclase 6
  Uniprot ID: O43306
  ENST ID: ENST00000307885
  CDS Start-End: 696-4202
ccggtctataggtgcataccaccacaccaggctaatttttttttttttgagacggagtctcactctgtcacccaggctggagtgcaatggcgcgatctttgctcactgcaacctctgccacccgggttcaagcaattctcctgcctcagctcctgagtagctgggattacaggcgcccgccaccacgcccggctaatttttgtatttttagtagagacgaggtttcaccatcttggccaggctggtcttgaactcctgaccttgtgatctacctgccagggccttccaaagtgctgggattacggacgtgagccaccacgcctggcccaggctaattttttgaaattttaatagaggcagggtcttgctgtattgcccaggttgctctcacattcctagccttaagccatcctcctatctcggcctcacaaagtgctgggattacaggtgtaagccactgtgcctggttttgggcaagtttcttgtcctgactgtgtcttgggttctcacctgttgattggggatacccttgttgcctacctccaagtaattttatgaggatgaaactcatagcttgtcagtgggaagtgcttaggtaatgagctactagtggtggcagtggctgtgatggtggtattaataccactcctactggatggtctctaatactatctccttccttccctaccagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcgggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacacaaaaaaagaagacatgatgttccacaagatctacatacagaagcatgacaatgtcagcatcctgtttgcagacattgagggcttcaccagcctggcatcccagtgcactgcgcaggagctggtcatgaccctgaatgagctctttgcccggtttgacaagctggctgcggagaatcactgcctgaggatcaagatcttgggggactgttactactgtgtgtcagggctgccggaggcccgggccgaccatgcccactgctgtgtggagatgggggtagacatgattgaggccatctcgctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctggccgcatccacatcactcgggcaacactgcagtacctgaacggggactacgaggtggagccaggccgtggtggcgagcgcaacgcgtacctcaaggagcagcacattgagactttcctcatcctgggcgccagccagaaacggaaagaggagaaggccatgctggccaagctgcagcggactcgggccaactccatggaagggctgatgccgcgctgggttcctgatcgtgccttctcccggaccaaggactccaaggccttccgccagatgggcattgatgattccagcaaagacaaccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaagtactcccggaaggtggatccccgcttcggagcctacgttgcctgtgccctgttggtcttctgcttcatctgcttcatccagcttctcatcttcccacactccaccctgatgcttgggatctatgccagcatcttcctgctgctgctaatcaccgtgctgatctgtgctgtgtactcctgtggttctctgttccctaaggccctgcaacgtctgtcccgcagcattgtccgctcacgggcacatagcaccgcagttggcatcttttccgtcctgcttgtgtttacttctgccattgccaacatgttcacctgtaaccacacccccatacggagctgtgcagcccggatgctgaatttaacacctgctgacatcactgcctgccacctgcagcagctcaattactctctgggcctggatgctcccctgtgtgagggcaccatgcccacctgcagctttcctgagtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttggcttcttccaatgagacctttgatgggctggactgtccagctgcagggagggtggccctcaaatatatgacccctgtgattctgctggtgtttgcgctggcgctgtatctgcatgctcagcaggtggagtcgactgcccgcctagacttcctctggaaactacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattgggctgaacatgggcccagtcgtggcaggtgtcatcggggctcggaagccacagtatgacatctgggggaacacagtgaatgtctctagtcgtatggacagcacgggggtccccgaccgaatccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagagg

SEQ ID NO: 105268 - DNA, 5748 bp, Homo sapiens
  Payload ID: 652
  Gene Symbol: ADCY6
  Gene Name: adenylate cyclase 6
  Uniprot ID: O43306
  ENST ID: ENST00000357869
  CDS Start-End: 8-3355
cagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcgggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacacaaaaaaagaagacatgatgttccacaagatctacatacagaagcatgacaatgtcagcatcctgtttgcagacattgagggcttcaccagcctggcatcccagtgcactgcgcaggagctggtcatgaccctgaatgagctctttgcccggtttgacaagctggctgcggagaatcactgcctgaggatcaagatcttgggggactgttactactgtgtgtcagggctgccggaggcccgggccgaccatgcccactgctgtgtggagatgggggtagacatgattgaggccatctcgctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctggccgcatccacatcactcgggcaacactgcagtacctgaacggggactacgaggtggagccaggccgtggtggcgagcgcaacgcgtacctcaaggagcagcacattgagactttcctcatcctgggcgccagccagaaacggaaagaggagaaggccatgctggccaagctgcagcggactcgggccaactccatggaagggctgatgccgcgctgggttcctgatcgtgccttctcccggaccaaggactccaaggccttccgccagatgggcattgatgattccagcaaagacaaccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaagtactcccggaaggtggatccccgcttcggagcctacgttgcctgtgccctgttggtcttctgcttcatctgcttcatccagcttctcatcttcccacactccaccctgatgcttgggatctatgccagcatcttcctgctgctgctaatcaccgtgctgatctgtgctgtgtactcctgtggttctctgttccctaaggccctgcaacgtctgtcccgcagcattgtccgctcacgggcacatagcaccgcagttggcatcttttccgtcctgcttgtgtttacttctgccattgccaacatgtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttggcttcttccaatgagacctttgatgggctggactgtccagctgcagggagggtggccctcaaatatatgacccctgtgattctgctggtgtttgcgctggcgctgtatctgcatgctcagcaggtggagtcgactgcccgcctagacttcctctggaaactacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattgggctgaacatgggcccagtcgtggcaggtgtcatcggggctcggaagccacagtatgacatctgggggaacacagtgaatgtctctagtcgtatggacagcacgggggtccccgaccgaatccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgt

SEQ ID NO: 105269 - DNA, 5877 bp, Homo sapiens
  Payload ID: 652
  Gene Symbol: ADCY6
  Gene Name: adenylate cyclase 6
  Uniprot ID: O43306
  ENST ID: ENST00000550422
  CDS Start-End: 137-3484
cggacggcggacggcgggcgggacggccaggacgcgcgggctcggaggaccgcgggacggccggccggccggccggagcccgcgggggcggcggggcgggggcccagggcaggcgcggagccgggccggcagcaacatgtcatggtttagtggcctcctggtccctaaagtggatgaacggaaaacagcctggggtgaacgcaatgggcagaagcgttcgcggcgccgtggcactcgggcaggtggcttctgcacgccccgctatatgagctgcctccgggatgcagagccacccagccccacccctgcgggcccccctcggtgcccctggcaggatgacgccttcatccggaggggcggcccaggcaagggcaaggagctggggctgcgggcagtggccctgggcttcgaggataccgaggtgacaacgacagcgggcgggacggctgaggtggcgcccgacgcggtgcccaggagtgggcgatcctgctggcgccgtctggtgcaggtgttccagtcgaagcagttccgttcggccaagctggagcgcctgtaccagcggtacttcttccagatgaaccagagcagcctgacgctgctgatggcggtgctggtgctgctcacagcggtgctgctggctttccacgccgcacccgcccgccctcagcctgcctatgtggcactgttggcctgtgccgccgccctgttcgtggggctcatggtggtgtgtaaccggcatagcttccgccaggactccatgtgggtggtgagctacgtggtgctgggcatcctggcggcagtgcaggtcgggggcgctctcgcagcagacccgcgcagcccctctgcgggcctctggtgccctgtgttctttgtctacatcgcctacacgctcctccccatccgcatgcgggctgccgtcctcagcggcctgggcctctccaccttgcatttgatcttggcctggcaacttaaccgtggtgatgccttcctctggaagcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacacaaaaaaagaagacatgatgttccacaagatctacatacagaagcatgacaatgtcagcatcctgtttgcagacattgagggcttcaccagcctggcatcccagtgcactgcgcaggagctggtcatgaccctgaatgagctctttgcccggtttgacaagctggctgcggagaatcactgcctgaggatcaagatcttgggggactgttactactgtgtgtcagggctgccggaggcccgggccgaccatgcccactgctgtgtggagatgggggtagacatgattgaggccatctcgctggtacgtgaggtgacaggtgtgaatgtgaacatgcgcgtgggcatccacagcgggcgcgtgcactgcggcgtccttggcttgcggaaatggcagttcgatgtgtggtccaatgatgtgaccctggccaaccacatggaggcaggaggccgggctggccgcatccacatcactcgggcaacactgcagtacctgaacggggactacgaggtggagccaggccgtggtggcgagcgcaacgcgtacctcaaggagcagcacattgagactttcctcatcctgggcgccagccagaaacggaaagaggagaaggccatgctggccaagctgcagcggactcgggccaactccatggaagggctgatgccgcgctgggttcctgatcgtgccttctcccggaccaaggactccaaggccttccgccagatgggcattgatgattccagcaaagacaaccggggcacccaagatgccctgaaccctgaggatgaggtggatgagttcctgagccgtgccatcgatgcccgcagcattgatcagctgcggaaggaccatgtgcgccggtttctgctcaccttccagagagaggatcttgagaagaagtactcccggaaggtggatccccgcttcggagcctacgttgcctgtgccctgttggtcttctgcttcatctgcttcatccagcttctcatcttcccacactccaccctgatgcttgggatctatgccagcatcttcctgctgctgctaatcaccgtgctgatctgtgctgtgtactcctgtggttctctgttccctaaggccctgcaacgtctgtcccgcagcattgtccgctcacgggcacatagcaccgcagttggcatcttttccgtcctgcttgtgtttacttctgccattgccaacatgtacttcatcgggaacatgctgctgagtctcttggccagctctgtcttcctgcacatcagcagcatcgggaagttggccatgatctttgtcttggggctcatctatttggtgctgcttctgctgggtcccccagccaccatctttgacaactatgacctactgcttggcgtccatggcttggcttcttccaatgagacctttgatgggctggactgtccagctgcagggagggtggccctcaaatatatgacccctgtgattctgctggtgtttgcgctggcgctgtatctgcatgctcagcaggtggagtcgactgcccgcctagacttcctctggaaactacaggcaacaggggagaaggaggagatggaggagctacaggcatacaaccggaggctgctgcataacattctgcccaaggacgtggcggcccacttcctggcccgggagcgccgcaatgatgaactctactatcagtcgtgtgagtgtgtggctgttatgtttgcctccattgccaacttctctgagttctatgtggagctggaggcaaacaatgagggtgtcgagtgcctgcggctgctcaacgagatcatcgctgactttgatgagattatcagcgaggagcggttccggcagctggaaaagatcaagacgattggtagcacctacatggctgcctcagggctgaacgccagcacctacgatcaggtgggccgctcccacatcactgccctggctgactacgccatgcggctcatggagcagatgaagcacatcaatgagcactccttcaacaatttccagatgaagattgggctgaacatgggcccagtcgtggcaggtgtcatcggggctcggaagccacagtatgacatctgggggaacacagtgaatgtctctagtcgtatggacagcacgggggtccccgaccgaatccaggtgaccacggacctgtaccaggttctagctgccaagggctaccagctggagtgtcgaggggtggtcaaggtgaagggcaagggggagatgaccacctacttcctcaatgggggccccagcagttaacagggcccagccacaaattcagctgaagggaccaaggtgggcattgagtggactctgtgctcactgggtggagctgtggcagggggcactgagcctccagaccctgctaaccacaaaagggaacatcccagcaggctgtgcttggatcatgctcgtctgccctcaagctggaaaacaaggggctacctaccgagaggattatgcaagtgactttctttcttacttggggtagggctgttccctctccaatcttccagcctttgggagcaggggaggggtcagtagcagaagcagagggaggcctcttgcctgagggattaaaatggcagcttgccatgcctacccttccctgtctgtctgggcagcaggttcagggctgagcccttcttttccctcttttttcctgggaatattttgtacaatattttgtacaaagacaggcatgaggagtgcctattccatgcttgcctttgcaatacctgcatccccagcactggtcctgggcacttccccaccccagccaggtgtccctcctatgcacagagcagaggagggagaagctctggggagccagctttggccatatttcaggagaatgtttccatgtgccaaatcttagtcccatgatctgtccccaaaggggaacaaagggacctctgacagcttagatttagccccagttcctgcacgctccagggaacggggtgtctggcctcactggtactgtgaaaaatgctcagagagcaagcctgtgtgtggggatgtcaggtcaggagctggaagttcacctgcaggtgccaaagagcaggccggccagggctggggcagtgccagactctgatctgaggaccccgtcggggtccagatcaggtcactctgccccagtgctctcttgctgtctgctgacaagggggcatggagcatctcttcctcttctgttgccaaatagaaaagggtcagggcatggagaaaggtgaccctgatcccaaacctgccctcccaagtctctggtgttggggagggcccgtgtgtttgtgtaactgtgtgtgcatgttggtctttgtgtgcatatctgttttccaggtctatgtgagtccttgtgctcctgctcctcagctctccaccccaggttgcctctctcctgtgggcctctgtcttctgggaataaagcagggtttcctacttcaggggatgtagagagatgcccaggttgcacaggagtgggatggggtgtggtagcaaaaggagggagaggagtcctttttgtgccaaatccctaagtgccgttcgggggccatgtgtgcagcatgactctccctgtctgtggcagggacccaagcgcttgcttaagccccagtgctccatgccagcacttgaactgtctggggtttgatggacagaggctgaggaatttcctggcttccccagatagtgtcctgggacatggtatgctttggggctggggtagcatggaatccctctgaggacctggatactggtactacggggtggggaagaggaaccttaaacttggctttccccagccttcagcctgagtctagcatgtttctagctccccagtcccttgtgaagccttgagggctggcagaagggttaggaggttgaactctagattcccttcctgtctttgccttccttttacccctttccctgcaacctccttgactctggcctgaatttgttggtgcctcagtttctctgtctgtacctatttaagccaaaggcactagcctgaattttgcttgaagatcactttgtcttggaaatgactagagaggcagaggagaagggtttccagagttgctaggtttgggagtggaaggggcaggcagtgcacttgcccctcctcatgccccttctgacaccagctccctgtggaggcctggtttctgggtaatgcctcccttgggcatcttcatgcatcaaccaaatgggccatcaggtacttcattagtcatggcagaaggaggggaaaagacttgttttccagacagaaaatctactcccctgtccccagccatatccctggataggaagggataggaagagactacttggtgccatggggtaggggtgagggtataagtagatcagagtgggaagacctcagccttgggtggcttgtctctgcttcttgccaggtgggagggcctgtccacaccctggatccccgtaccacagtgccagccatgcccttcccctgggctaccattgtccctttcctcacccagttggtagaggagtcaggaggtgggaggccgtgggctttggttttataatgtaaccactgtgggggtgggggaggatggtgaaccatgtatttcagtgaaatatttaatatatttaaatatcaataaaatcaaactctttgt

SEQ ID NO: 105270 - DNA, 382 bp, Homo sapiens
  Payload ID: 652
  Gene Symbol: ADCY6
  Gene Name: adenylate cyclase 6
  ENST ID: ENST00000548820
  CDS Start-End: 135-382
gtaatgggagagatatattgcaggggtggcagtggcttggggacagacagggtgcaggaccctggcttccttcctcagagaacctagcaagttgtgtgaatgtgtgtgtgtgtttaggggggcaggcagaggagatggtcactgtctgcctctgccacctcctgcagctcggtgccaatgtgctgctgttcctctgcaccaacgtcattggcatctgcacacactatccagcagaggtgtctcagcgccaggcctttcaggagacccgcggttacatccaggcccggctccacctgcagcatgagaatcggcagcaggagcggctgctgctgtcggtattgccccagcacgttgccatggagatgaaagaagacatcaacac

SEQ ID NO: 105271 - DNA, 6138 bp, Homo sapiens
  Payload ID: 653
  Gene Symbol: ADCY7
  Gene Name: adenylate cyclase 7
  Uniprot ID: P51828
  ENST ID: ENST00000254235
  CDS Start-End: 269-3511
agctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagttaaacgaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttgaaaaactc

SEQ ID NO: 105272 - DNA, 6213 bp, Homo sapiens
  Payload ID: 653
  Gene Symbol: ADCY7
  Gene Name: adenylate cyclase 7
  Uniprot ID: P51828
  ENST ID: ENST00000394697
  CDS Start-End: 341-3583
ccggagcaggaagtggtgggtcccagatgtgactcactctcattaggtagcgtggaaggagccttcggatggagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgtactacacctgcagctgtgtcctgggcttcatcgcctgctcggtcttcctgaggatgagcctggagccaaaggttgtgctgctgacagtggccctggtggcctacctggtgctcttcaacctctccccatgctggcagtgggactgctgcggccaaggcctgggcaacctcaccaagcccaacggcaccaccagtggcacccctagctgttcctggaaggacctgaagaccatgaccaatttctacctggtcctgttctacatcaccctgcttacactctccagacagattgactattactgccgcttggactgcctatggaagaagaagttcaagaaggagcacgaggagtttgagaccatggagaacgtgaaccgccttcttctggagaacgtcctgccagcccacgtggctgcccactttatcggtgacaagttaaacgaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgagctcctactgaagcccaagttcagcggcgtggagaagatcaagaccatcggcagcacgtacatggcagctgcagggctcagcgtcgcctcagggcacgagaaccaggagctggagcggcagcatgcccacattggtgtcatggtggagttcagcatcgccctgatgagtaagctggacggcatcaacaggcactccttcaactccttccgcctccgcgtcggcataaaccatgggcctgtgattgctggagtgattggggcccgaaaacctcagtatgacatctggggaaacactgtcaatgtggccagccgaatggaaagcactggagaacttgggaaaatccaggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttgaaaaactcaaa

SEQ ID NO: 105273 - DNA, 2090 bp, Homo sapiens
  Payload ID: 653
  Gene Symbol: ADCY7
  Gene Name: adenylate cyclase 7
  ENST ID: ENST00000537579
  CDS Start-End: 270-1571
gagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgcacctgcatactgttttttcccgtttaaatgagctcacttcataagaaataaaactacagtg

SEQ ID NO: 105274 - DNA, 670 bp, Homo sapiens
  Payload ID: 653
  Gene Symbol: ADCY7
  Gene Name: adenylate cyclase 7
  ENST ID: ENST00000566761
  CDS Start-End: 345-670
cacagaggaggccagggaagctctagaggcgttttttggccaaggggtcaagttcctgtctgcttcgtctccgcagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccaggggagacatggcctcgctatgttgcccaggctggtcttgaactcctggcctcaagtaatcctcctgccttggcctcccaaagtgttgggattacaggacccctccagacaccaggccattctgggcatggcgttcctggtgctggcggtgtttgcggc

SEQ ID NO: 105275 - DNA, 2304 bp, Homo sapiens
  Payload ID: 653
  Gene Symbol: ADCY7
  Gene Name: adenylate cyclase 7
  ENST ID: ENST00000567277
  CDS Start-End: 104-1696
cagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtgagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgcacctgcatactgttttttcccgtttaaatgagctcacttcataagaaataaaactacagtgaaaacaacactgga

SEQ ID NO: 105276 - DNA, 2535 bp, Homo sapiens
  Payload ID: 653
  Gene Symbol: ADCY7
  Gene Name: adenylate cyclase 7
  ENST ID: ENST00000566433
  CDS Start-End: 306-2510
actctcattaggtagcgtggaaggagccttcggatggagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtgctgatgtacgtcgagtgtctcctgcggcgctggctcagggccttggcgctgctcacctgggcctgcttggtggcgctgggctatgtgctggtgttcgacgcatggacaaaggcggcctgtgcgtgggagcaggtgcccttcttcctgttcattgtcttcgtggtgtacacactactgcccttcagcatgcggggcgctgtcgccgttggggccgtctccactgcctcccacctcctggtgctcggttctttgatgggaggcttcacgacacccagtgtccgggtggggctgcagctgctggccaacgcagtcatcttcctgtgtgggaacctgacaggcgccttccacaagcaccaaatgcaggatgcatcccgggacctcttcacctacactgtgaagtgcatccagatccgccggaagctgcgcatcgagaagcgccagcaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcagcatcctctatgcggacatcgtgggcttcacgcagctggccagcgactgttctcccaaggagctggtggtggtgctgaatgagctctttggcaagttcgaccagatcgccaaggccaacgagtgcatgcgaatcaagatcctcggcgactgctactactgtgtatcgggcctgcccgtgtcgctgcctacccacgcccggaactgcgtgaagatggggctggacatgtgccaggccatcaagcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccggccgggtgcacatcacggaggccacgctaaagcacctggacaaggcgtacgaggtggaggatgggcacgggcagcagcgggacccctacctcaaggagatgaacatccgcacctacctggtcatcgacccccggagccagcagccacccccgcccagccaacacctccccaggcccaagggggacgcggccctgaagatgcgggcgtcagtgcgcatgacccggtacctcgagtcctggggggcggcacggccctttgcacatctcaaccaccgtgagagcgtgagcagtggtgagacccacgtccccaacgggcggaggcctaagagcgttccccagcgccaccgccggaccccagacagaagcatgtcccccaaggggcggtcggaggatgactcgtacgatgacgagatgctgtcagccattgaggggctcagctccacgaggccctgctgctccaagtccgatgacttctacacctttgggtccatcttcctggagaagggctttgagcgcgagtaccgcctggcacccatcccccgggcccgccacgactttgcctgcgccagcctgatcttcgtctgcatcctgctcgtccatgtcctgctcatgcccaggacggcggcactgggtgtgtccttcgggctggtggcctgtgtactggggctggtgctgggcctgtgctttgccaccaagttctcgaggtgctgcccagctcgggggacgctctgcactatctctgagagggtggagacacagcccctgctgaggctgaccctggccgtcctgaccatcggcagcctgctcactgtggccatcatcaacctgcccctgatgcctttccaagttccagagctgcctgttggcaatgagacaggcctactggccgcgagcagcaagacaagagccctgtgtgagcccctcccgcacctgcatactgttttttcccgtttaaatgagctcacttcataagaaataaaactacagtgaaaacaac

SEQ ID NO: 105277 - DNA, 497 bp, Homo sapiens
  Payload ID: 653
  Gene Symbol: ADCY7
  Gene Name: adenylate cyclase 7
  ENST ID: ENST00000569265
  CDS Start-End: 447-497
gtcagttgataaacactgttgcctgaacacccgctgtgtgcagagacctagcagataccctggttggggcagtgctaaggattctgccttctgggagctcatttcctgagcagaattccctcttggtacctggcctggcacctggtgcacagaaggcatgagtgcacatctgctgaagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgac

SEQ ID NO: 105278 - DNA, 578 bp, Homo sapiens
  Payload ID: 653
  Gene Symbol: ADCY7
  Gene Name: adenylate cyclase 7
  ENST ID: ENST00000564965
  CDS Start-End: 336-578
gtgccgggccagcccgctgccactggggcggccactcgggcggcggtggagcgggagcgcgcagcagagctgaggaactgcgtgtggagtcagcccagtctggatgcacaggaggatgctggcggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagccagcatgggccgctgctgctcacgctcctgctggtggccgccactgcctgcgtggccctcatcatcattgccttcagccagggggacccctccagacaccaggccattctgggcatggcgttcctggtgctggcggtgtttgcggccctctctgtg

SEQ ID NO: 105279 - DNA, 5938 bp, Homo sapiens
  Payload ID: 654
  Gene Symbol: ADCY8
  Gene Name: adenylate cyclase 8 (brain)
  Uniprot ID: P40145
  ENST ID: ENST00000286355
  CDS Start-End: 2094-5849
actggctgcagccgcagtcttggtggaggaggtggtgaccaccaccgctcctccacctgcatccggctgcgggactgcggcggccgcgtttgccctgcagaccctgcaccccgggacgcggctcatctgtcattagcaccggcactaagctcccaccgctcagcgacttggtccgccgcaagctccgccgcaggctttgtccgctagcgctcggctgagtctgggcgggcgggaaacctgggctagggcgaggcggggcccctggacatgcctttctccacgtccgcctcctcgaccctattgtaagcggagaaacttagtgtgcgaggcaggcaggggacgtccccattttgatgtcccgtaccctccacccccttcggatcgaggtagtaaagaggctcctgtaggaaactgactgcctctatgattgcggcctcttgggggattttgcgtttagcccgaaagttggctttgccaaaagacgcacgggtaggaagggcgaaaaggaaaccctgtattccgtcgcgctgggctctccgagtccgtgcgcaaagcggcctacgagtcctggctccgcacctgcagaggacaagagccaatgcctaaaaaagaacagcggaggaaccggctggcgcggccagctggaacgctggatcgcagtgcgcccagggaaggccgggggcgcccgccggccctagccctcagtggtcctctcccacgccggcccgcgcgtgcctctgcctacaagacctggggcgtcctggccagatctggatggcaggtccctccgccacccccggcccggttccgggggcgtggcttggcgcgggggcgggtttaagtcaccgcgggtgtctgaccactctgacaggtctccaaatttctcccagtcgcctggcgcccgcggtgcgtttcagagctccagggtggcacgcggcggcgcttccctagatccagaggcgtctctgtcgacttccacgcggcctcgggcctcccttctcctccaaaccttcgcctcatccgccaagcttcggttctcagcctcagatatccgcaccggcggcttctcttcgttctcggagctcttggctttggagccctcaccactttttccttcccccgcctctcctgatcctcctagctccgagccaaatggactccaaagaacgaaataaaggggatgagaactgtgtgctgcgacccttcgaaagcacagctgaaagcgttgacctcgtcttatagctcaggctgggaccctggagcgagagtccccacaccccctccgggagggatgcttctggccagagccagcgctgcgctgtcagtccttgctcccgaactaggaaagagcctaggagggagcctcagcataccccttcctccaaattaactatttggtgaattgttagcgccgaggctaccacctctccaaccctgtcgcggggcgccccgccacctcaccgtgaccccctcctcctccttctttgcccccgcccccagctccgcccctgctccccatcccggcgcaatggagttctccgaagggcgatgattccagccacatctgctaacttcgcacccatcgctgccgccggtcaccgccggccaggccccctgcagccgcggagcagtgggcgtccaaagcccagtgcagcagccaggacccgcccgacgcgcagcagaagcacggcgcccaggcgcttaggcgtctcttggagagcaaaggctgcgccaaaacgctgagcctagaatcaaccaaggagcctgagcccaggaaggggctgcgtggctcacagcgctgcggctcctgaggacaaatagccactgccgctgcgtacccaagctgcgccggctggcgggagagcagcacgcaaggacgccgaggtccgccgcgatcttccaggtgccctttgcccctgggcacagtatgacccgacctacagggagccctagcgcagggctcctgcaacggggcagcctaggataaaaaggatccttgccaagctcctaccaggccgcctttgagtctttaggaacccctcctccggctgcctccccaaggttctgggcctccttccctgcggcccagagccatggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacgcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggttgtggcccaggcagtgctattcatgtgtatgaacacagctggaatcttcatcagttacctgtcagaccgggcccagcgccaagctttcctggagactcggaggtgtgtggaggccaggctgcgcctggagacagagaaccaaagacaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactaaggaagtggcagtttgatgtctggtcttgggatgtggatattgcaaacaaactcgaatctggaggaatccctgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtattctcaaatgagggatgaagtgttcaagtcaaacttggtctgtgcatttatcgttcttctatttatcacggcaatacaaagtttgcttccttcttcaagagtgatgccaatgaccatccagttctccattctgattatgctgcactcggctctggtcctcatcaccacagcagaggattataaatgtttgcccctcatcctccggaaaacttgctgttggattaatgagacctatttggcccggaacgtcatcatctttgcatccattttgattaatttcctgggtgccatcttaaatatcctgtggtgtgattttgacaagtcgatacccttgaagaacctgactttcaattcctcagctgtgtttacagatatctgctcctacccagagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgttggggtgatgtttgcctccatcccaggatttgcggacttttactctcagactgaaatgaataaccagggagtggaatgcctgcgcttgctcaatgagatcattgctgacttcgatgagttgcttggtgaagaccgatttcaagacattgaaaagattaagaccattggcagcacctacatggccgtgtcaggcctgtcacctgaaaaacagcaatgtgaagacaagtggggacatttgtgtgctctggctgacttctcactcgccctgacagaaagcatacaggagatcaacaagcattcattcaacaattttgaactccggattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataaaagcattttctttctgttttttttttttgtatttcttttatatataaaataaatatactaataaaaaggtttaattttttttagaacaa

SEQ ID NO: 105280 - DNA, 3363 bp, Homo sapiens
  Payload ID: 654
  Gene Symbol: ADCY8
  Gene Name: adenylate cyclase 8 (brain)
  ENST ID: ENST00000377928
  CDS Start-End: 1-3363
atggagctctccgatgtgcgctgccttacaggcagcgaggaactctacaccatccacccgacgcccccggccggcgacggcaggagcgcctcccggccgcagcggctgctgtggcagacggcggtgcgacacatcacggagcagcgcttcattcacgggcaccggggaggcagcggcagcgggagtggaggctcgggcaaagcctcggaccctgcgggcggcggccccaaccaccacgcgccgcagctgtcaggcgactcggcgctgcccctctactcgctgggcccgggagagcgagcgcacagcacctgcggcaccaaagtcttcccggaacgcagcgggagcggcagtgccagcggcagcggaggcgggggcgacctgggcttcctgcaccttgactgtgcccctagcaactcggatttctttcttaatgggggctatagctaccgaggggtcattttccccaccctgcgcaactccttcaaatctcgggatttggaacgcctctaccagcgctatttcttgggccaaaggcgcaaatcggaagtggtgatgaacgtgctggacgtgctgaccaaactcactctcttggtcctacacttgagcctggcctcggcccccatggacccgctcaagggcatcctgctgggcttcttcaccggcattgaggtagtgatctgcgccctggtggtggtcaggaaggacaccacctcccacacgtacctgcagtacagcggcgtggtcacctgggtggccatgaccacccagatcctggcagcaggcctcggctacgggctcctgggcgacggcataggctacgtgctcttcacgctcttcgccacctacagtatgctgccgctgccgctcacctgggccatcctggccggcctgggcacctcgctgctgcaggtcatcctccaagtggtcataccccggctggcggtcatttccatcaaccaggttgtggcccaggcagtgctattcatgtgtatgaacacagctggaatcttcatcagttacctgtcagaccgggcccagcgccaagctttcctggagactcggaggtgtgtggaggccaggctgcgcctggagacagagaaccaaagacaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactaaggaagtggcagtttgatgtctggtcttgggatgtggatattgcaaacaaactcgaatctggaggaatccctgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaatactctggctgccctaacaagaaattcaataaatctgcttccaaaccatcttgcacaagctttgcatgtccagtctgggcctgaggaaattaacaagagaatagaacataccatcgacttgcggagtggcgataaattgagaagagagcatatcaagccattctcactgatgtttaaagactccagcctggagcacaagtactttgtcttcacgggggtgttggccatggtgacctgtgcagttttcctccggctgaactccgtcctgaagctggcagtgctgctgatcatgattgccatctatgccctgctcactgagaccgtctacgcaggcctctttctgcgttatgacaacctcaaccacagtggagaagatttcctggggaccaaggaggtatcactgctactgatggccatgttcctcctggctgtgttctaccatggacagcagctggagtacacagcccgcctggacttcctttggcgagtacaggccaaagaggagatcaatgagatgaaggagctgagggaacacaatgagaacatgctccggaatatcttacccagccatgtggcccgccatttcctagagaaggaccgagacaatgaggagctgtattctcaatcctatgatgctgttggggtgatgtttgcctccatcccaggatttgcggacttttactctcagactgaaatgaataaccagggagtggaatgcctgcgcttgctcaatgagatcattgctgacttcgatgagttgcttggtgaagaccgatttcaagacattgaaaagattaagaccattggcagcacctacatggccgtgtcaggcctgtcacctgaaaaacagcaatgtgaagacaagtggggacatttgtgtgctctggctgacttctcactcgccctgacagaaagcatacaggagatcaacaagcattcattcaacaattttgaactccggattggcatcagccacggctcagtggtagctggcgttatcggcgctaagaaaccacagtatgacatttggggcaaaactgtgaacctggcaagccgaatggacagcacgggggttagtggccggatccaagtcccagaggagacctatctcatcctgaaggaccagggctttgcctttgattaccgaggggagatctatgtgaagggtatcagtgaacaggaaggaaaaatcaaaacgtactttcttctgggaagagtccaacccaacccattcatcttgcccccaagaagactgcctgggcagtactccctggccgcggttgtcctgggacttgtccagtccctcaataggcaaaggcagaagcagctactcaatgagaacaacaacacaggaatcatcaagggtcattacaaccggcggactttgttgtcacccagcggcacagagcctggagcccaggctgaaggcaccgacaaatctgatttgccataa

SEQ ID NO: 105281 - DNA, 928 bp, Homo sapiens
  Payload ID: 654
  Gene Symbol: ADCY8
  Gene Name: adenylate cyclase 8 (brain)
  ENST ID: ENST00000522949
  CDS Start-End: 173-928
ctggtgaaggggagacagataaggttgtggcccaggcagtgctattcatgtgtatgaacacagctggaatcttcatcagttacctgtcagaccgggcccagcgccaagctttcctggagactcggaggagcggctcgtgctttctgtgctcccccggtttgttgtcctggaaatgatcaacgacatgaccaatgtggaagatgagcacctgcagcaccagttccatcggatctacatccatcgctatgagaacgtcagtattctttttgcagatgttaaaggatttaccaacctctccacgaccttgtctgctcaggagctggtcaggatgctcaacgagctctttgccagatttgatcgactggcccatgagcatcactgccttcgtattaaaatcctgggggactgctactactgcgtgtctggacttcctgagccccgccaggaccatgcccactgctgtgttgaaatgggtctcagcatgatcaaaaccatcaggtatgtgcggtcaaggacaaaacacgatgttgacatgaggattggaatccactccggctcggtgctgtgcggtgttttgggactaaggaagtggcagtttgatgtctggtcttgggatgtggatattgcaaacaaactcgaatctggaggaatccctgggaggattcacatttccaaagccacgctggactgtctcaacggtgactataacgtggaagagggccatggtaaagagaggaatgaattcctgaggaagcataatatcgaaacttacttaattaagcagcctgaggacagtctgctgtccttgcctgaagatatcgtcaaggagtcagtgagctcctcagaccggagaaacagtggggccacattcactgaaggatcctggagccctgaactgccctttgataatatcgtggggaaacagaat

SEQ ID NO: 105282 - DNA, 7725 bp, Homo sapiens
  Payload ID: 655
  Gene Symbol: ADCY9
  Gene Name: adenylate cyclase 9
  Uniprot ID: O60503
  ENST ID: ENST00000294016
  CDS Start-End: 540-4601
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccgggcccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtactggtgaccccggccggggcaggccccgggactcgacaacatggcttccccaccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagattacttttttaagccgcccattaatcagttcagcctgaacttcctggatcaggagctggagcgatcctacaggaccagctatcaggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccatgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgttcctctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccatcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccagagacatacagattgccctccccggcatgaagaagtcacaattctgacccgccacctctccaggggcggtgcctgggatggccacccatcaggacagccagagccagggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaata

SEQ ID NO: 105283 - DNA, 697 bp, Homo sapiens
  Payload ID: 655
  Gene Symbol: ADCY9
  Gene Name: adenylate cyclase 9
  ENST ID: ENST00000576936
  CDS Start-End: 1-646
ggaagaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacagttctgtattaacttcgccccttgacgcagtacagaatttcagaagacgagaaccctgtggagagggagactccaagtttcccttcagttcacaggaagagagttgccgtgcaggagcctaattgtaaatttgaaaaaattaaaaactgcttatgctctgtcaattaccaaaa

SEQ ID NO: 105284 - DNA, 569 bp, Homo sapiens
  Payload ID: 655
  Gene Symbol: ADCY9
  Gene Name: adenylate cyclase 9
  ENST ID: ENST00000571467
  CDS Start-End: 1-217
atttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacagcctgatgaaagat

SEQ ID NO: 105285 - DNA, 772 bp, Homo sapiens
  Payload ID: 655
  Gene Symbol: ADCY9
  Gene Name: adenylate cyclase 9
  ENST ID: ENST00000572288
  CDS Start-End: 1-772
atcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcgg

SEQ ID NO: 105286 - DNA, 918 bp, Homo sapiens
  Payload ID: 656
  Gene Symbol: ADCYAP1
  Gene Name: adenylate cyclase activating polypeptide 1 (pituitary)
  Uniprot ID: P18509
  ENST ID: ENST00000450565
  CDS Start-End: 120-650
agacaccaacgccagacggcgatgcctctcgggtggtgactccagcgcaggaacttgaagaagcgctttgcccgccgtcctacctggcagctctcctggcagcgggaggagttgaaggaatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcgatggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatatatatatat

SEQ ID NO: 105287 - DNA, 3346 bp, Homo sapiens
  Payload ID: 656
  Gene Symbol: ADCYAP1
  Gene Name: adenylate cyclase activating polypeptide 1 (pituitary)
  Uniprot ID: P18509
  ENST ID: ENST00000579794
  CDS Start-End: 279-809
attctttcgcttggcatcgcgtcaggggagttagctttccttcagccgggtctggctagttattgggcgccgggtagatgcatatatatatatttttttctaactatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagaatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcgatggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcacccagcaatcagatcgagcagcaacagacaaaccagccagccaatctcccaaatttcaggcacaagtttatttatttatttttttatgttttgaaaaaagaagatgaagaagaagaaaaaaaaaagaacaaggaaagattaaacgttagcttgtaaagtttaaaggacctttccttttcctttacggatttgatcagtatgaagtcataaatcaaagaaaacagaattggatttgcattcccaggcgggatggatgctgccaggagatcacattgcaaatagtgaaaacagaggcattcggtctatgcctgagtcctgtgtataggatcaatcttcctttaattccgcagtctcctcaggcaatgtgacacgggatgcagtttgcagctttagtgcctttcttcgccttttaaattgccacgaatcacagatggctatttagtggccctacaatgctgcaacacatcagcttgcattttagtcttaattatttgtttcttggataatgggcagagttttctgtatttgtatcagctgttagtggtgaaatagggctctagttaaccttttatttatgaagtctaatttagtgttcccgtggctagttgcaagcattttacagtgatcacccagtttaatcttttgtatactttttagaaatgccaagagccttactaaactgaagcagatttatgatatagtgataatttaggtagatgttagtcttgaagctcttattttgtgtgcaactgattataaaaacaccttaaccaagtattattacacacatgatatctataactaggactttgataactgttatataaagtgtgtaaaatttgtatgaataaatttttgtaaacaatgcaa

SEQ ID NO: 105288 - DNA, 6487 bp, Homo sapiens
  Payload ID: 657
  Gene Symbol: ADCYAP1R1
  Gene Name: adenylate cyclase activating polypeptide 1 (pituitary) receptor type I
  Uniprot ID: P41586
  ENST ID: ENST00000304166
  CDS Start-End: 290-1696
gcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaacagccccccatcatctgattttgggtgtgacccctcgagtgtgcatgccaccctggggctcttctcagtcctgggcccaagtccctgaagcctagcagagggccagctcgggtggccagaacaccccttggtgcaggcctcctggcactcgcctggcatcttggtgtccgggtgctcagctcctgggtcccagggcagtgggacagctcccaggctcttctcatcagagacttcagtttgggtggggagtctgcaggtcagggaaggttctggtgcttttcgtttgatccaaaaggagctgagagccagaaatgtggctgtgattgcgaaagagacggagtttgggagacccatggaagaaaaccttcgccatctccattgttttacccccagctcaagatggacagggttcttctggtcatctcccttccacctcttccaccctcatggatgccttccagaagctgtctccaaccatgcacaccacagagagcccttaagccctcccctccccatttcccctaagtcaaagccatgactaggatgtaccagccacctgcctctgatgtcggcgaatcctgaagcacctgcacccgaatctggggcccagggctgcccgacccccactcccatggatgatgaggagccccagacaccagctcctctggcctggactcaactattgaaatctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctctttttttttttttttgagtagtacccttgccctcttcatggccacttcaaagtgaagccagcaaagtgataatactttatcatttagtattatcataaagtattaatactttgtcataaagtcctccttgagcccagggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttttc

SEQ ID NO: 105289 - DNA, 1587 bp, Homo sapiens
  Payload ID: 657
  Gene Symbol: ADCYAP1R1
  Gene Name: adenylate cyclase activating polypeptide 1 (pituitary) receptor type I
  Uniprot ID: P41586
  ENST ID: ENST00000396211
  CDS Start-End: 72-1562
cccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctc

SEQ ID NO: 105290 - DNA, 1761 bp, Homo sapiens
  Payload ID: 657
  Gene Symbol: ADCYAP1R1
  Gene Name: adenylate cyclase activating polypeptide 1 (pituitary) receptor type I
  ENST ID: ENST00000409489
  CDS Start-End: 27-1601
gccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaatt

SEQ ID NO: 105291 - DNA, 1889 bp, Homo sapiens
  Payload ID: 657
  Gene Symbol: ADCYAP1R1
  Gene Name: adenylate cyclase activating polypeptide 1 (pituitary) receptor type I
  Uniprot ID: P41586
  ENST ID: ENST00000409363
  CDS Start-End: 224-1567
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactg

SEQ ID NO: 105292 - DNA, 466 bp, Homo sapiens
  Payload ID: 657
  Gene Symbol: ADCYAP1R1
  Gene Name: adenylate cyclase activating polypeptide 1 (pituitary) receptor type I
  ENST ID: ENST00000431811
  CDS Start-End: 245-466
atccaggttttctgggcactcgtgtgtcttgcctgtgccaggtgctgtgggcacacgcacgtcagagctgggctcatgctcacttaggagaggctgaagcttaaccagcgtctgcacaaagggaaaggcgctcagtgcagagctactcctctccacaccacaccccctgccggcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctg

SEQ ID NO: 105293 - DNA, 441 bp, Homo sapiens
  Payload ID: 657
  Gene Symbol: ADCYAP1R1
  Gene Name: adenylate cyclase activating polypeptide 1 (pituitary) receptor type I
  ENST ID: ENST00000436116
  CDS Start-End: 1-441
ggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttaacaaatttaagcccgcgagtccccaagaaagcccgagaggaccccctgcctgtgccctcagaccagcattcactccctttcctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttct

SEQ ID NO: 105294 - DNA, 6575 bp, Homo sapiens
  Payload ID: 657
  Gene Symbol: ADCYAP1R1
  Gene Name: adenylate cyclase activating polypeptide 1 (pituitary) receptor type I
  Uniprot ID: P41586
  ENST ID: ENST00000614107
  CDS Start-End: 290-1780
gcgagcgtggtccccgcgtgcgcacacgcacacgccgccgcgcagggacacacggaccccggccgccagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttcagctgcgtgcagaaatgctactgcaagccacagcgggctcagcagcactcttgcaagatgtcagaactgtccaccattactctgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaacagccccccatcatctgattttgggtgtgacccctcgagtgtgcatgccaccctggggctcttctcagtcctgggcccaagtccctgaagcctagcagagggccagctcgggtggccagaacaccccttggtgcaggcctcctggcactcgcctggcatcttggtgtccgggtgctcagctcctgggtcccagggcagtgggacagctcccaggctcttctcatcagagacttcagtttgggtggggagtctgcaggtcagggaaggttctggtgcttttcgtttgatccaaaaggagctgagagccagaaatgtggctgtgattgcgaaagagacggagtttgggagacccatggaagaaaaccttcgccatctccattgttttacccccagctcaagatggacagggttcttctggtcatctcccttccacctcttccaccctcatggatgccttccagaagctgtctccaaccatgcacaccacagagagcccttaagccctcccctccccatttcccctaagtcaaagccatgactaggatgtaccagccacctgcctctgatgtcggcgaatcctgaagcacctgcacccgaatctggggcccagggctgcccgacccccactcccatggatgatgaggagccccagacaccagctcctctggcctggactcaactattgaaatctctctgagacctctgcaaagatgtcccttttatgcccttgaccttgactcaccatgggctgctggggtgtcgggagaagccacacccaacatgcccattagcagaggctgctgctgatgtggcagctgctccctaccacccgccctggctccccagctgcaggttgcacaccctcagcctgagaatgtaaaatagggcagtgcccagctggggaggtagaggaaagtgctagagtacatggtccgtgtgtggcctagctcattccatgtcagcatttggtgttactcctgtccaaattctgtttgcagacttgtttcatgatgatgctctggaatgcttggggactttgggtggaggaggatgttacttcattttataaagaggaaggggcctgggagacttgggaaaatgtttctggagaggctttcagagtggctggaaaaggctcttgttgctgtaatttagagaggagctctgtgtccttggccagtcaagtaagttcctggatctttggcaaagccagaggaagaaaggagctacctgccctttcctgggcatgcttggtgactcagattgatcttggagtgtgcagtggcccttctaccctgcacctgacctcatgatcccctccacctgcactggtgtgcattactgaagcaagggtcctgtggacatcttgcattttgggcactgctagggggtctgggctgcttggaaggagccatggcctagggttcagggaactagactctatcccagttgggttcagactgctgtgactgtggacacgatgctccttgttctgggctccagttttcccatttgtgagatgaggcaacttccaatgcttctctaggccctgcacgtaagtgatttttccagttcaaagtcaagacaggtaaaagggcattcatcattgtgcctcatatcaggttttgatgaatatatgtgtgtgtgtgtgtgtgtgtgtgtgtgtgtgtgtagagggatggacaggatgctgtttattttccctttcttggaaatggaccttctgtcccttccatttggacaccacagtggaagctggtggcctggaaggaaggattaggtcatggacatttgaacaggtgccttgggcatgatgtatagatgcagtcatatataccttgctggggtggggtgccacctccagtggccagctccagatccaaggagcagccccctggggatggaccccattcattcatcatgactcccaacagttttcattgtggaagaagaaactttggcattatagagacatcatcacaaaacagtaaaaacaaaatcaaccctgaaccccatgcactgtgctgcttcctgagcctggccctgcatcctcatagaggtgccgggttcctattggttagttggttgtttttccgtctgagtgaatttttgccagtcttgtgagcagatgtacctgatgtattctcaatgttccaagaggttctggccttcagggtcacaggcagtagggggacagcataaggtctatgtaaaacccttccctctctgaccctctgttttcaaatctgtaaaatgggcaataagactagatgatttgtatatagcccaatgcatctctggaactctgtctaaacaccagccatctacttggaatgggccccaggactgtggtatttgcctgggccaggaaaggataagaaatcctgtcatgtgaagacagcttgagaggcttgagaaaagtggggctggggagaagcaggcttgtcagactccacccctgttgatgatcattcctgggaaggggtttctcgttctatgcaatcctaaaggacgaaactcacccatgggaggccgaattctccttgggatgaagaaatttctctttccctgtcatgagtgtccagccagggagcagggaggcagtgtcagggagggactctcatcctggaggaaatgggattccaagtcaaggatgctgaggctgtcagggagccagagaggggggtccaagtgcgggatgtgggtggctctgtggttcagtggctctgtggtagttcctagcactgcagacttcatgactccccacttaagtccaagtcacattgtctatcccagtgtgtagctctgtcaccctgcttgacacatccagtggcctacagcgactcttctctaaccccaccccctccaagctgggttctttgtggaagaaggacagggagctagagccaagccctaggcttgagagacacctgcatctataatccccgccaaggatgcccactcacctctctcatctgatcctcactctttgtggaagggaaagctcaaagggactctctctctctctctctttttttttttttttgagtagtacccttgccctcttcatggccacttcaaagtgaagccagcaaagtgataatactttatcatttagtattatcataaagtattaatactttgtcataaagtcctccttgagcccagggaccatggaagtcagctagaagagccctgagcaaggagcaaggacttgggcttctccacgctttgctcctggcttgtttgaccttgactcattccccatatgtctttgaggaggctcacaaaatactaaagctgggaggaaacttggagatctataggtcaaacctccccattgggctgatgagaaaatacacgcaggcctagcatggtgcctgccaccatggtgggatccagtatgttttataaatctgaatgagtaaatggctcaccaatttatgcatagccctgcacatgagcagaatgtgacactcaaagcatccatgcagtacgcatgtaaccttgcacaggagtggggctctggtgaccgaaggttgtccaggactcttgcaggagaagcaatggagtcagtgtggtgtggggagacctactttttaacctgggcttagccacctgctctgtgatccagggcttaccttctttgggcctcggcctcctaatctgggtaatggggaggacttcattggcattgttagtcccacaggccaaggataaggttgaaatgagacggcttgtgtgtgaaaagattttggaaattacacagatgtgggcttgttattgggatgaagactgctggaagggactccttgctgtttatctactgctttgagccctcctaagttaacctgtgcctcatttgtaaaaccaccagcatcaggagtaagggggaggccagagggctcagatggacacagaattctagctttacctgcatccgctgattcagttttctgttgggatcagagtgaggatacttccatatgggtgatagcagccatgcccctgggagtcaacttcaaggatctgggacattttggtgtgcccattccttcttttcctgaactcacagtcttggggtgtttctgcacttggctatgtgtgtcttgtctgatgtctgtcttctgtagctttgcctctatcagggctggagtggtgcagcccctggcatctcagacatggttcctgcctcacttgtgggagctggaccagcctgggtttcatctcccacagtaaagctaagtaagccccacagaccttactgctactgctgctgccattaatgctgtgctcactatcttgtccaggattttaaggatgtcagactgctgtagatgactcaataaatgttttgccatttttcctgg

SEQ ID NO: 105295 - DNA, 736 bp, Homo sapiens
  Payload ID: 658
  Gene Symbol: AK1
  Gene Name: adenylate kinase 1
  ENST ID: ENST00000223836
  CDS Start-End: 97-729
gctaagcccccactgccgggggaggcgggtgatgggccggcccagggcctgagaggggaagggcagggtgcacaggagacacggcaggacgggaccatgggctgctgctcctcgagtgacccccgcagagaagacgatctgagagccagagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgct

SEQ ID NO: 105296 - DNA, 757 bp, Homo sapiens
  Payload ID: 658
  Gene Symbol: AK1
  Gene Name: adenylate kinase 1
  Uniprot ID: P00568
  ENST ID: ENST00000373156
  CDS Start-End: 164-748
gggagtttcgaggggagcagctctgcagttgtgtggccgctgtttatgtccctcggtgccatcctcactgtcccagcccctccagcgggaacccaggtggatgggagggggctactgcccttctgtgacagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctgg

SEQ ID NO: 105297 - DNA, 2266 bp, Homo sapiens
  Payload ID: 658
  Gene Symbol: AK1
  Gene Name: adenylate kinase 1
  Uniprot ID: P00568
  ENST ID: ENST00000373176
  CDS Start-End: 154-738
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcccctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgagaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaa

SEQ ID NO: 105298 - DNA, 525 bp, Homo sapiens
  Payload ID: 658
  Gene Symbol: AK1
  Gene Name: adenylate kinase 1
  ENST ID: ENST00000413016
  CDS Start-End: 1-407
gaagaaaaccaagatcatctttgtggtgggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagcc

SEQ ID NO: 105299 - DNA, 574 bp, Homo sapiens
  Payload ID: 658
  Gene Symbol: AK1
  Gene Name: adenylate kinase 1
  ENST ID: ENST00000550992
  CDS Start-End: 82-180
acgggcagggcacgcactggccccggcgcccacccgcacccctccccagagcactgacacggctcccgggacctcggcaggatggaaggagcgccagcggtgtctgtccctccgcctggggcccagcacaggcctgggactccagaggtgcctctggctgtgggtccagcgagtgactgagccctgctccccttttctctcccgcagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccat

SEQ ID NO: 105300 - DNA, 532 bp, Homo sapiens
  Payload ID: 658
  Gene Symbol: AK1
  Gene Name: adenylate kinase 1
  ENST ID: ENST00000550143
  CDS Start-End: 1-156
gagaaggggcagctggttccactggagacagtgttggacatgctccgggatgccatggtggccaaagtcaatacttccaaaggcttcctgattgatggctacccgcgggaggtgcagcaaggagaagagtttgagcgacgggccctgagaccatgacccagcggctcttgaaacgtggagagaccagcgggcgtgtggacgacaatgaggagaccatcaaaaagcggctggagacctattacaaggccacagaacctgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattcgaggtcctcctggcctgagcgcagcgcctccaccctgccctgctgagcacagacggaggaagccgcttatcctgttttcatggacagctgagcactaaaggaatttctaagga

SEQ ID NO: 105301 - DNA, 1021 bp, Homo sapiens
  Payload ID: 659
  Gene Symbol: AK2
  Gene Name: adenylate kinase 2
  Uniprot ID: P54819
  ENST ID: ENST00000354858
  CDS Start-End: 165-884
gtgaagagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgta

SEQ ID NO: 105302 - DNA, 3586 bp, Homo sapiens
  Payload ID: 659
  Gene Symbol: AK2
  Gene Name: adenylate kinase 2
  Uniprot ID: P54819
  ENST ID: ENST00000373449
  CDS Start-End: 43-741
gtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 105303 - DNA, 920 bp, Homo sapiens
  Payload ID: 659
  Gene Symbol: AK2
  Gene Name: adenylate kinase 2
  ENST ID: ENST00000487289
  CDS Start-End: 17-505
agagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaagcattgaacacagaaatgcctctgcttctggacacgtttgttctgacagaccaacactgctttagcctacagttgtctctaccctgtttcactaatcactgccatctgctttgtgccttccagaagtatgacagaagctttcaactgcaaatggaccctccattcccttctttattgtgggctgtagcttttttatgtctttgtcattttaatggtgtctcaggaaagtggtcagccaaccatcttgaaccagacatccatgaccattacttttaattgctgtgtaatatttcacagtaggttaaccattgtttacttatttccttattgttgtacatttatgtttcttccagttagccactgttaaaatgatactatggccatcataatgcatgtaaatttttggattagggaaaaaatgttttcttatttcagacattattactttgatttcctaatgaggttgaacatcttttccat

SEQ ID NO: 105304 - DNA, 880 bp, Homo sapiens
  Payload ID: 659
  Gene Symbol: AK2
  Gene Name: adenylate kinase 2
  ENST ID: ENST00000467905
  CDS Start-End: 59-757
gggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgctgatcatctgagagcagtcaaatctacttccccaaaaagagaccaggcctagtatcagaaggccaggcgagactgcaacactgctcatcaccccgcggcgtgatccctgctcttaggtgctgggca

SEQ ID NO: 105305 - DNA, 936 bp, Homo sapiens
  Payload ID: 659
  Gene Symbol: AK2
  Gene Name: adenylate kinase 2
  ENST ID: ENST00000548033
  CDS Start-End: 13-585
acttcggcggacatggctcccagcgtgccagcggcagaacccgagtatcctaaaggcatccgggccgtgctgctggggcctcccggggccggtaaagggacccaggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagct

SEQ ID NO: 105306 - DNA, 886 bp, Homo sapiens
  Payload ID: 659
  Gene Symbol: AK2
  Gene Name: adenylate kinase 2
  ENST ID: ENST00000550338
  CDS Start-End: 75-203
gtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccagttggagaaactgaagtttgaatggcttgttctctaggctacatagcaagtaatttacagagcttgcatctgaatgactccaaagctcctgctctttctgctgctatctactgccccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacat

SEQ ID NO: 105307 - DNA, 811 bp, Homo sapiens
  Payload ID: 659
  Gene Symbol: AK2
  Gene Name: adenylate kinase 2
  ENST ID: ENST00000480134
  CDS Start-End: 50-451
tggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgta

SEQ ID NO: 105308 - DNA, 160 bp, Homo sapiens
  Payload ID: 659
  Gene Symbol: AK2
  Gene Name: adenylate kinase 2
  ENST ID: ENST00000626911
  CDS Start-End: 32-160
gaactggtggcagtgagagacttcggcggacatggctcccagcgtgccagcggcagaacccgagtatcctaaaggcatccgggccgtgctgctggggcctcccggggccggtaaagggacccagttggagaaactgaagtttgaatggcttgttctctag

SEQ ID NO: 105309 - DNA, 3576 bp, Homo sapiens
  Payload ID: 659
  Gene Symbol: AK2
  Gene Name: adenylate kinase 2
  ENST ID: ENST00000629371
  CDS Start-End: 84-485
gtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgt

SEQ ID NO: 105310 - DNA, 1536 bp, Homo sapiens
  Payload ID: 660
  Gene Symbol: AK3
  Gene Name: adenylate kinase 3
  Uniprot ID: Q9UIJ7
  ENST ID: ENST00000359883
  CDS Start-End: 132-605
acacactcttttacgttatttataaaagagtctcactcaatggaagctggatttcctctcctgtaaaatgagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaa

SEQ ID NO: 105311 - DNA, 2736 bp, Homo sapiens
  Payload ID: 660
  Gene Symbol: AK3
  Gene Name: adenylate kinase 3
  Uniprot ID: Q9UIJ7
  ENST ID: ENST00000381809
  CDS Start-End: 232-915
gtcgggggcggggggtgcgccggggtagccgagaggcggacgcaacagcggggtcccgcgctgtctgggcggccccaggggctgtcggctcacttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaatcataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtcca

SEQ ID NO: 105312 - DNA, 705 bp, Homo sapiens
  Payload ID: 660
  Gene Symbol: AK3
  Gene Name: adenylate kinase 3
  Uniprot ID: Q9UIJ7
  ENST ID: ENST00000447596
  CDS Start-End: 141-704
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacaggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgag

SEQ ID NO: 105313 - DNA, 4029 bp, Homo sapiens
  Payload ID: 660
  Gene Symbol: AK3
  Gene Name: adenylate kinase 3
  Uniprot ID: Q9UIJ7
  ENST ID: ENST00000611749
  CDS Start-End: 139-612
gagtgggcgccaggtggaggtggggccagggttgtcaagggagcacgaaaggggtcgcggtgtgtccggcaaggactggaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaatcataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtccataggctggtttcagtttatgcaatacttcatctcctgctatggtagccataccggccttcataatacccttaggggatttggaaatcaaagtgagcagtggaagaacatggctatgagaattaagactcttatttcctgtgaccattccctccccacccgcaaacacttagcccaaagttttgcacatacattcattactttaggaatgaatatgactgtaatacaacttttttctttatttttttttagacagggcctcactctgttgcccagactagagtgcagtggcataattgggtcactgtaacgttgaactcctgggctcacgcaattcttctacctcagcctcccaagtagctgaaactacaggtatgtaccaccatgcctggctaattttatttttttgtagagacggcgtctcgatatgttgcccaggctagtctcctggcctcaaacagtcttcctgattcagcttcccaagtgctgagattacaggtgtaagccactgcccccacccaaaaaaataattctgtaatgaccatcattaagatttatgtaccacatggaaatacatgtatggagctgaatgccatggctaggagaaactactatacttttgttaaaagccaatgagaggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaaaaaaaaaaaattagccgggcatggtggcgggcgcctgtagtcccagctactcgggaggttgaggcaggagaatggtgtgaatccgggaggcggaggttgcagtgagctgagatcgtgccactgcactccagcctgggcgacagagggagactccgtctcaaaaaaaaaagccagggagaacagcacctcaactgatttattttatagagtaaaagttattttgctataccttttgtaagcagcgtgtactgtgggaaatgcaaactagcagttgttagcaccatccagaaatttctgtcagttccatttcaaatagtttaaatactggctcaaatctctaaaccccaccctatggctacttttcccccagctatatataatggcattctagcaagatattttggatcctcataacttgtgacaaaactgccctatactaacaacaaatcattgtaattatagatctcaaattatgttaaattgctatagttgcaaccaacagcaagaatttgtattttagaatatgttgtgtcttctcattgaccaaaaaataaaaataaaaataaaaataaatcctcaggccctgataaactgtagaaatagcttttctatctttgcagttaaagattttcatcttggaagttatggttaaaaaatttttaaacagttaaaatagtgtagctgtgcttaaagcttctggtaaaagccagtatgctttgtagagcccttatccccctcctgctttttatttgtttttagctcactaaataatataaacactgatttttccatatatagcactgaataaactgtcatgcctaagtgt

SEQ ID NO: 105314 - DNA, 6836 bp, Homo sapiens
  Payload ID: 661
  Gene Symbol: AK4
  Gene Name: adenylate kinase 4
  Uniprot ID: P27144
  ENST ID: ENST00000327299
  CDS Start-End: 206-877
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttata

SEQ ID NO: 105315 - DNA, 6998 bp, Homo sapiens
  Payload ID: 661
  Gene Symbol: AK4
  Gene Name: adenylate kinase 4
  Uniprot ID: P27144
  ENST ID: ENST00000395334
  CDS Start-End: 359-1030
agccgccggggaggggacgagacgcagaccacacgttgcccacgtgcgaggaccgggcaggggctcagcccctaggccgcccggtgcgtggggcggcgggggctggctttgagtcacccccgcttgtgccagcttccccggctcggcggagactggcttggggatgcctggccgcccggcccccttctcggacgcggcgtggggagcgagctggagttaaggatgaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 105316 - DNA, 6887 bp, Homo sapiens
  Payload ID: 661
  Gene Symbol: AK4
  Gene Name: adenylate kinase 4
  Uniprot ID: P27144
  ENST ID: ENST00000545314
  CDS Start-End: 248-919
ttacgtaaggcgcgagtcccgcgcggccggccggggctccgcgactgggcgggcggaggcggcgccgccctgcaggatccgggctggaagcctctcggagtgctgcctccagccaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttgttttgttttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccagcccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 105317 - DNA, 1335 bp, Homo sapiens
  Payload ID: 661
  Gene Symbol: AK4
  Gene Name: adenylate kinase 4
  ENST ID: ENST00000546702
  CDS Start-End: 106-621
gtgtttatttgattgcttttggtggcgaggcgcggggctcgggctcgtcgcgcgccccatggccggggagcgcatccgccaaccccgggcggagaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattct

SEQ ID NO: 105318 - DNA, 3929 bp, Homo sapiens
  Payload ID: 662
  Gene Symbol: AK5
  Gene Name: adenylate kinase 5
  Uniprot ID: Q9Y6K8
  ENST ID: ENST00000344720
  CDS Start-End: 1027-2637
agtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttggtctgttctaagccacaacccctgtctcaggtcgtttggcttcctttccttctctttgtatttgaatttaaaaacattcctgaatctcaagtgcttttgcttgaagtaggggggaggaggagaaaagaatagaagcaagccaggcttcctaagcgagctctgaaaggagaaatccattcactgcaaacctcgttccccatttctgaaaacggatagactgatatcgtaaactaaaggtcatgagggtttttccccccggtttgggggatttgttctgttaaaaggaattttaaagcaccacttgagaaaataattttgcctcagtttccctaaactatctttaaaatgggttgccataattacaggtcttcttttctctcacctctataagccaccgttttcaggtcatctgaagtcaagatttccagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagac

SEQ ID NO: 105319 - DNA, 3251 bp, Homo sapiens
  Payload ID: 662
  Gene Symbol: AK5
  Gene Name: adenylate kinase 5
  Uniprot ID: Q9Y6K8
  ENST ID: ENST00000354567
  CDS Start-End: 264-1952
gcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacaggataa

SEQ ID NO: 105320 - DNA, 556 bp, Homo sapiens
  Payload ID: 662
  Gene Symbol: AK5
  Gene Name: adenylate kinase 5
  ENST ID: ENST00000478255
  CDS Start-End: 262-495
ctccacacctccctgcaagctaaggaagccggctccggccttgggcagcccagaaaggggctcccacagtgcagcggcgggctgaagggctcctcaagcgcggccagagtgggcgccaaggcggaggaggcgctgacatcgagcgggggctgtgagggctgccagcatgctgtcacctctcagtcccactagatcccaagaggcagcagaggcagcttctgaaaaataaaataaattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaa

SEQ ID NO: 105321 - DNA, 653 bp, Homo sapiens
  Payload ID: 662
  Gene Symbol: AK5
  Gene Name: adenylate kinase 5
  ENST ID: ENST00000478407
  CDS Start-End: 124-653
tgttgctcagtcttcagaccgcagcacagcatcatctgcaccgggacccgggaatggggggacacttggagactgagagagaggaggctcgaggaatgaaccttgagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaa

SEQ ID NO: 105322 - DNA, 381 bp, Homo sapiens
  Payload ID: 662
  Gene Symbol: AK5
  Gene Name: adenylate kinase 5
  ENST ID: ENST00000527263
  CDS Start-End: 1-188
caggatctgattatgaagatcagggtgatgaccagttaaatgtatttggagaggacactatgggaggtttcatggaagatttgagaaagtgtaaaattattttcataattggtggtcctggctctggcaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattcctt

SEQ ID NO: 105323 - DNA, 1183 bp, Homo sapiens
  Payload ID: 663
  Gene Symbol: AK6
  Gene Name: adenylate kinase 6
  Uniprot ID: Q9Y3D8
  ENST ID: ENST00000380818
  CDS Start-End: 339-848
cccaggaaagcttgaaggcagagatagactcacgtctctaagacatatacataatatagccgcaaccgcggcggccttactttcccggagctgcatccccttttaggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaa

SEQ ID NO: 105324 - DNA, 1648 bp, Homo sapiens
  Payload ID: 663
  Gene Symbol: AK6
  Gene Name: adenylate kinase 6
  Uniprot ID: Q9Y3D8
  ENST ID: ENST00000380822
  CDS Start-End: 53-571
gtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttaggaaataatgttactggtttcctatatgtctttttagaggttttatgcctgcacagtgtatatgtacatgtgtacattttttaaagaatataacagtatattatgcacactattctgtacctttcttttttcacttactatatttgaagattatatcatctcagtacagacctccctgttcttttttttagttgagatagatatacatatcatacaataaaatttaccattttgaagtgtataatcagaaccgggtatggtggcttatgcctgtaatcccagcaaatggggaggctgaggtggagaatcgcttgaggcaggagttcaagaccagcctgggcaacatagtgagaccttagactctaaaaataaacataaataaaatttataatccgttggtttttagcttattaacaaggttatgtaactgtcaccactgtggaggaagcagtgatgataaagggaactcctataccctttagcagtcactctctattctttcctcctcatccccttgcagtcactagtctactttctgtctctatggatttgcatattctggatatttcatataaatgggattatacagta

SEQ ID NO: 105325 - DNA, 587 bp, Homo sapiens
  Payload ID: 663
  Gene Symbol: AK6
  Gene Name: adenylate kinase 6
  ENST ID: ENST00000512561
  CDS Start-End: 31-456
gaggcgcccgaagccgtcgcggcggggaccatgttgcttccgaacatcctgctcaccgagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggttta

SEQ ID NO: 105326 - DNA, 1283 bp, Homo sapiens
  Payload ID: 663
  Gene Symbol: AK6
  Gene Name: adenylate kinase 6
  ENST ID: ENST00000617893
  CDS Start-End: 291-1085
gcggctgggccgccggggcaggctaggggcgccgcggtgggcttcggggcctttggggccgtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattc

SEQ ID NO: 105327 - DNA, 1331 bp, Homo sapiens
  Payload ID: 663
  Gene Symbol: AK6
  Gene Name: adenylate kinase 6
  ENST ID: ENST00000616867
  CDS Start-End: 337-1131
gtgccactgcactccagcctgggcgacaagagtgaaactctgtctcaaaaaaaaaattttacatatgattgctaattaggaaatttttcatttcagtcgtcaagaacttttaagggcagaggccaggtgagactctgtctcaaaaataaaaggaaaggcagaaggtggaccgcagtgtgataagtagtatttcacaaacagtatttttctgtggcttgtcttacaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcga

SEQ ID NO: 105328 - DNA, 754 bp, Homo sapiens
  Payload ID: 663
  Gene Symbol: AK6
  Gene Name: adenylate kinase 6
  ENST ID: ENST00000622801
  CDS Start-End: 449-754
atttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacc

SEQ ID NO: 105329 - DNA, 1461 bp, Homo sapiens
  Payload ID: 663
  Gene Symbol: AK6
  Gene Name: adenylate kinase 6
  ENST ID: ENST00000615404
  CDS Start-End: 468-1262
cccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcg

SEQ ID NO: 105330 - DNA, 483 bp, Homo sapiens
  Payload ID: 663
  Gene Symbol: AK6
  Gene Name: adenylate kinase 6
  ENST ID: ENST00000618980
  CDS Start-End: 1-330
atgttgcttccgaacatcctgctcaccggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggtaagaaaggaaaaacattagattcttaaagcataatgttaacttttattcagatttctgaaattggccatgataaaagattgttgttgtttgttttgttttgttttgttttgtttttttgagatagagtctcgctgtcacccaggctggagggcag

SEQ ID NO: 105331 - DNA, 582 bp, Homo sapiens
  Payload ID: 663
  Gene Symbol: AK6
  Gene Name: adenylate kinase 6
  ENST ID: ENST00000620800
  CDS Start-End: 202-582
acatcctgctcaccggtcagggcgcgcggccgggagggactgggctggggcaggctgggggcgcagagtgctctgggcatcgggcgcccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactat

SEQ ID NO: 105332 - DNA, 966 bp, Homo sapiens
  Payload ID: 663
  Gene Symbol: AK6
  Gene Name: adenylate kinase 6
  ENST ID: ENST00000622236
  CDS Start-End: 374-966
atgttgcttccgaacatcctgctcaccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccgggggggggcgggggggggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagc

SEQ ID NO: 105333 - DNA, 743 bp, Homo sapiens
  Payload ID: 663
  Gene Symbol: AK6
  Gene Name: adenylate kinase 6
  ENST ID: ENST00000502819
  CDS Start-End: 14-157
cgcggcggggaccatgttgcttccgaacatcctgctcaccggtacaccaggggttggaaaaaccacactaggcaaagaacttgcgtcaaaatcaggactgaaatacattaatgtgggtgatttagctcgagaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaacagagtattccttttttctttctttaaattagaaaaaaagttaagtgttgtactcgatacaaagttcaaaaggtacaaaag

SEQ ID NO: 105334 - DNA, 588 bp, Homo sapiens
  Payload ID: 663
  Gene Symbol: AK6
  Gene Name: adenylate kinase 6
  ENST ID: ENST00000616112
  CDS Start-End: 182-588
tacacgcgcgagccaccacacgtggccatgaacagtttttaaatctttataagttaaagcaaataggccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggc

SEQ ID NO: 105335 - DNA, 761 bp, Homo sapiens
  Payload ID: 663
  Gene Symbol: AK6
  Gene Name: adenylate kinase 6
  ENST ID: ENST00000617775
  CDS Start-End: 263-761
ccgaccctcgcgggcgttgcgggaggcgagggaggggacgcggaacgttaattccgttggcctgaggctccgggggggggcgggggggggtggagagaggtcggcagatccagctctccagcttggcaacctgcttagtctttctgaatctggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccc

SEQ ID NO: 105336 - DNA, 3300 bp, Homo sapiens
  Payload ID: 664
  Gene Symbol: AK7
  Gene Name: adenylate kinase 7
  Uniprot ID: Q96M32
  ENST ID: ENST00000267584
  CDS Start-End: 45-2216
aagcgagtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgccatctctcgagaagaccttctcatgcgcctgctggagtgtgatgttattatttataacatcactgagagctcacagcaaatggaggaagccatctgggcagtctctgcactcagtgaagaagtcagccactttgaaaagcgaaagctatttattttactgtcgacggtgatgacttgggcgcgctccaaagccctggaccccgaggattctgaggttccattcactgaagaagattatcgaagaagaaagtctcatcctaattttctggaccacataaatgctgaaaaaatggttctcaaatttggaaaaaaggccagaaaatttgcagcatacgtagttgctgctggactccagtatggagcggaaggaggcatgttacacacattttttaagatggcttggttgggcgagattcctgcattaccagtttttggcgatggaacaaatgtaattccaacaatccatgttcttgatctagcaggagtgatacaaaacgtcatagatcacgtgccaaagcctcactacctggttgctgtggatgagtctgttcataccctggaagacatagtcaagtgtatcagtaaaaatactggccctgggaaaatccagaaaatacccagagaaaatgcatacctaaccaaggacttaacgcaagattgtcttgaccatttactggtcaacttaagaatggaagcgctctttgtgaaggagaattttaatattcgatgggctgcccaaacaggatttgtggaaaatatcaacactatcctcaaggagtacaagcaaagcagaggattgatgccaatcaagatctgcattcttggtccccctgctgtgggaaaatccagtattgctaaagaattggccaactactacaaactgcatcacatccaactgaaggatgtcatttctgaagccatagcaaaactggaggcgattgttgcccctaacgatgtaggggaaggagaagaagaagtcgaagaggaagaggaggaggagaatgtggaagatgcacaggagctcctagatggcatcaaggagagcatggagcagaatgcaggtcaactagacgatcaatatataattagatttatgaaagaaaagctaaaatcaatgccttgcaggaatcaaggttatattttggatggattcccaaagacctatgatcaagcaaaagacctgttcaatcaggaagatgaggaggaggaagatgatgtcagaggcagaatgtttccctttgataaattaattatacctgaattcgtttgtgcactggatgcttcggatgagtttctgaaggagcgtgtgataaaccttcctgagagcatcgtggcggggacccactacagccaagaccgattcctccgggctctgagcaactaccgggacatcaatatcgacgatgagactgtcttcaactattttgatgaacttgaaattcacccgatacatattgatgtaggaaaacttgaagatgctcagaatagacttgctatcaaacagctcatcaaagagattggggagcctcgaaattatggtttaacagacgaagaaaaggcagaagaggagcggaaggctgcggaggagcggctggccagggaggctgctgaggaagcagaacgcgagcaccaggaggccgtggagatggcagagaagatagctcgctgggaggagtggaataaacgactggaggaagtgaaaagagaagaaagagaattactggaggctcagtcaattcccctgagaaactatttaatgacctatgtgatgccaactcttattcagggcctgaatgaatgttgcaacgtccgacccgaagaccctgttgattttctggcagaatatctcttcaagaacaatcctgaagcacagtgaaacttgaaagatctggtattatctacctttacagaaccacagatcacttattatactttgaaaaattgctttgaaaaatgcttttccagttcttagaaaattctttttttgtagacaaatattctataaactagaatctctattaaaagctatatgacatgactatgtcattaaaactatatttgaaatgtaaattgataaagacatttgtgcatagctcatgagacaaatactgatttaatattttattctttagtcagatctaaatataccgcttctgtacactaatgtttataggtatttatagcatgaagaaaatcagactatatattgtagactatgtattattctaacatgtaggctaatttacatgacttgttatcgccccaataacaatgttattagaaatggaaataaattgaagtgatttatgcctgttgactcacagtaaatcagacaagattggtgcctgtaaggtggctttttttttttttttttttaaatgaagcaatggttagggaaaggttgctttgagttcagggtcaggatcccagacaatgaatcggagagaactgtaaacctttaggcggagaaatctgcataacaggataattccaatctttgtgataagtgagaagttgctaaatattttcaacacactttataacataggcataagttatcaatcctatagtcttttccagttctaaaaatcccataagattcctagaattaccctaaatgagaaattagtttaggtttaatggcatatgtattttatctctttaaataatgtaacctaatataactgcccgactttttatttgtgctaaaatacatgtaacataaaattgaccactgtaaccattttaaagtgtataattcagtggcactaagttcattcacaatgatctgcagccaccactatctagtccagaactttctcatcaccccaaatggaaacccagcacctattaggcagtcacgctccattattccctccccccagttccaggcaaccacgaatctgctttctgtctctatggatttacctattataaataaaaccatataatgggtggtc

SEQ ID NO: 105337 - DNA, 715 bp, Homo sapiens
  Payload ID: 664
  Gene Symbol: AK7
  Gene Name: adenylate kinase 7
  ENST ID: ENST00000554706
  CDS Start-End: 1-457
tctcctggtatttaaagatgtaggaaaacttgaagatgctcagaatagacttgctatcaaacagctcatcaaagagattggggagcctcgaaattatggtttaacagacgaagaaaaggcagaagaggagcggaaggctgcggaggagcggctggccagggaggctgctgaggaagcagaacgcgagcaccaggaggccgtggagatggcagagaagatagctcgctgggaggagtggaataaacgactggaggaagtgaaaagagaagaaagagaattactggaggctcagtcaattcccctgagaaactatttaatgacctatgtgatgccaactcttattcagggcctgaatgaatgttgcaacgtccgacccgaagaccctgttgattttctggttggaatgcaatggcacaatctcggcttactgcaacctccacctcccgggttcaagtgattctcctgccttagcctcccaagtagctgggattacaggcgcctgccaccacactcagctaatgttttgtattttagtagagaggaagtttcaccatgttgaccaggctggtctcgaactcctgacctcaagtgatccacccgcctcagcctcccaaagtgctgggattacaggcatgagccaccaagcttggcccaggatgatttttaaattgtaaacattactaatacaaatacatgactaataataacttgtaaa

SEQ ID NO: 105338 - DNA, 1345 bp, Homo sapiens
  Payload ID: 664
  Gene Symbol: AK7
  Gene Name: adenylate kinase 7
  ENST ID: ENST00000555570
  CDS Start-End: 23-346
agcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgtaagtcccggaggctctggccaggagtagacagagggaagagtcaccttccgctccaacgccttgacaacttgttttactgtttgcctcccctcccctctcttccacagacatggccaggttgagggaatggctttctcctgtaatggagatttacctcacagaccccacttttaattttcggccaaagcaaagagtttaaattagatagtgttggaaaggatggatctaagttggactttcagactcatacagttctcctcttcagcatattctgccttgcattatccaagacgagtctgtgccatgatgggtgccatctgtgaaggagaaataggccaggcgcggtggcttacgcctgtaatcccagcactttgggaggctgaggagggaggatcgcttaaggccaggggttcgagaccagcctgggcaacatagcaagatcctgtctcttatatttatgaaaataattttttaagagaaacatcctttggtaatgcaccactcaggaataatataccactgctgtctccagaaacaatgctgtctccacgtgacaaattcaacacagtcctagtcctgagacatttaaatgtctgagaagaagtggccctcttcttctcctgggccaactcctcccttaccctgcctgctactctctggagcctaccatacagctttccacatgctgtaccctggagtggccttctctctttttttttttattcatccttcaagagttgtgtctcttcctccaggaagccgttcatgattcctacttctccctcactcccagtttggattctgagctcttttctgagctcccatatcatcctttgcctgcctagatcatagtgcttttcacactcgttgttatcacctgtctatcgtgggggtccatggacactgactgtcagctccttgagggtggagaccgtgacttgtttatccctgtgtttatccatgtatctgtggcacctaacacagccactgccacaaagtggcctcaataaacacttgtggaatgga

SEQ ID NO: 105339 - DNA, 2072 bp, Homo sapiens
  Payload ID: 665
  Gene Symbol: AK8
  Gene Name: adenylate kinase 8
  Uniprot ID: Q96MA6
  ENST ID: ENST00000298545
  CDS Start-End: 523-1962
cggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccgggccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaagacagttcccagcgcgctgctcgtccagctgattcaggaacgcctggctgaagaggattgcatcaagcagggctggattctggatggcatccctgagacgcgtgagcaggctctgaggatccagaccctggggatcacacccagacacgtcattgtgctgagtgctccagacacggtcctgatcgagagaaacttggggaagagaatcgaccctcaaactggagagatttatcacaccacctttgactggccacccgaatctgaaatccagaaccgtctcatggtgccagaggacatctcagagctggagacggctcagaaactgctggagtatcataggaacatcgtcagggtcattccctcctaccccaaaatcctcaaagtcatcagtgctgaccagccatgtgtggacgtcttctaccaggctctgacctatgtccaaagcaaccatcgtactaatgccccgttcaccccgagggtgctgctgctcgggcctgtgggcagtgggaaaagtctgcaggccgccctcctggcccagaaatacaggcttgtcaatgtctgctgtgggcaactgctgaaagaggctgtggcagataggaccacgtttggcgagctcatccagcccttctttgaaaaggagatggcagttcctgacagcctcctcatgaaggtgctgagccagcgcctggaccagcaggactgcatccagaaaggctgggtgctacacggcgtcccgcgggacctcgaccaggcacacctgctgaaccgcctgggctacaatcccaacagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacag

SEQ ID NO: 105340 - DNA, 2566 bp, Homo sapiens
  Payload ID: 666
  Gene Symbol: AK9
  Gene Name: adenylate kinase 9
  Uniprot ID: Q5TCS8
  ENST ID: ENST00000285397
  CDS Start-End: 83-1348
atagagaggtcgggtagaggctcccgggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaatatctgaacctaaaaagagcagctattctaaccaaacttcagggtgcagaggaagaaattaatgacacaatggaaaatgatgagctatttcgtactcttgcatcttataaacttattgcaccaagatacagatggcaaagaagtaaatggggacgtacatgtcctgtgaatttaaaagatggtaacatttattcaggattaccagattattctgtgagttttctaggtaaaatctactgtctttcatcagaagaagcattaaaaccatttttgttgaacccacgtccctatctgcttccacctatgccaggaccaccatgtaaagtattcatacttggacctcaatattcagggaaaacaacactttgcaatatgcttgcagaaaattacaaaggaaaggtgactaactaactatctgtctatctatctatctatctatctatctatctatctatctatgtctatctgtcatgtatctatactcgattataatttgtaggattttatttgtactcagtttttaaaatttcatgttttaattgaataattgttccactgggcttggggtagggtaggcattctttttgttgtttattgctgcttccagaccagagtccctccctgcttcccaaaagctcccacatgtgaatatcgtgtcattcagactctgccacctattagctttcttggttctactcatcttctgtcccctgggtttcacttctcctggctcactctcactctccccatataatcactcctgtcctaattcttggtgatttcagtattacaaagatgatcctcccaacaccttgacacctccctcagtaatcttgttctccactctcagtaaatgaaattatttttagcttagacaagagtgatagcagtaaaagtggtatgaaacaagcatatttgggatataatttgaagacaaagctgaaagatttgatgagggattggaatgtggaggaattctagaaggggcaatgtggcttgaggattgcctatgcaagaaggaatggcacaagatcatggctaaagacagagcaattcaggccacagaaaggtgttagaagttgttcaaagtgctgttgcattcttttaagcgccggagtatcattttctatttgcttttaactttttcattgtgaaacatgacaaacatacagaaaagtgaagcccactgagttaccgcaaaatgaacccccatgtaaccaccaaccaggtcaaatctggaatgttgccagcacccagacgccctctcatgtttcttctcaataccagtctcctcactctccacacaaaggtaaccactgcccagaattttatggcattcacttccatacttctcctatggttttgccgtggaagcatacatccaaataccataggctagttttgcatggtttttttgaattttatagacctaaacaatttatcttctttgtgcctggcttctttcacttaacattataattatgatatttgtccagactattgaatgtagctgtagtttattcatttttattgttttattgtattctgttgattgacttataccataatgtatttatccacatttgagcactaataaaacttggattgattccagattggagtaaataa

SEQ ID NO: 105341 - DNA, 2499 bp, Homo sapiens
  Payload ID: 666
  Gene Symbol: AK9
  Gene Name: adenylate kinase 9
  Uniprot ID: Q5TCS8
  ENST ID: ENST00000355283
  CDS Start-End: 248-1258
attctcagtgctgctttattttcctcatgaaaataaagaaacttagaatgtgcacttagagtaatatatgagaaactgatttttaattaattaaaataatataaggactggctttttgtggatagttttcaagttgctacagattaaatattattcaagaagcattttaaaaaattatctgcatcaaaatacttttttagtttaatgttctccaaactttgaataccgtttctagggtgaagataaaatgaaggagagaaagaggcatttgggagacacaaaacacttttgtccggtggtcctcaaagaaaacttcatcctgcaaccaggaaacacagaagaagcagccaagtatcgagaaaagatctactacttttcaagtgctgaggctaaagaaaagtttttggagcatcctgaggattatgtggctcatgaagaaccattgaaggctcctccattaagaatatgccttgtcggcccccagggctctggcaaaactatgtgtggaagacagttggcagaaaaattaaacatttttcacattcagtttgaagaagttcttcaagaaaaactactactcaaaactgaaaagaaagtgggacctgaatttgaggaagattctgagaacgagcaagctgccaaacaagaacttgaagagcttgcaattcaggccaatgtcaaagttgaggaagaaaatacaaaaaagcagcttccagaagtacaacttacagaagaagaagaagtaatcaaatcaagtctaatggaaaatgagcccttgcctcctgaaattcttgaagtaattctttctgagtggtggcttaaggaaccaatacgttccacaggttttatattagatggtttcccacgatatccagaagaggcccagtttttgggagatcgtggatttttcccagatgcagctgtttttatacaagttgatgatcaagatatttttgatcgcctccttcctgcccaaattgaaaagtggaaactaaaacaaaagaagaaattagaaaggaagaaactgatcaaagacatgaaggcaaaaatcagggttgatacgattgctaaaagaagggctgaacttatattagagagagataaaaaaaggagggaggtaagtagttttgttttttttttcaaaacagggtctcactctgttgcccagggcagggtacagtggcacaatcatagctcactgcaacctcgaactcctgggctcaagggatcctcccacctcagcctctcaaagtgctaggattacaggcatgagccatcacacccagcctttgccttctggcttaagacactcttgtaacagcttttcaaggctgaccctcttgtaacctgatttccatctgtataaaaatgtccagccaaacaaggagaagagaaaaagaggaatatcagaaaatacaacttgctacaagtgcaaccacatgtcaccctggtgtgaatatgctggacttccgtacagaggactgctgatattgtacagtgcaactgcaactgcaactgcaggcacaaagcattgcagaagcggggccaaagtaattgttgctttgtcaaaacaaaatattcacaaccaaaagtagataagaaaaaaccattggactgagaaaattatggcaccatgtaagaataagaaccctcctcttaattatttgcctcgattttcattcatttattcattcagtccatcagcaaacattaattgagctttgtgtctgacactgtttcaaatactggcaaatcagccatgagcaaaacttacagaaatcgtagcctcattataatgctcatttctctcatcaaacatgttctgaaagtttgctctgtttaaggtgtcatgctaatgtttaggatcaaaaagatgtcctaacctggaattaagtacagttaactactttaagcccttgggagtccctagtggtccccttctgaatcacttcaaatgtttcagcagtgaaggagtccaggctttgcagttaaacacacctacgcagtatcccttctccagttctcactgactttgttcactgctctccagtgcctggtggagtgctgacacatgtgacattcaacttcagttgtttcgctgaggttgtataacattgagtaagtcacttagcctctgtaaacctagggctttttattgtaaaatgggaaaaattaatacatttagtttccctaattaataataatttaatttccctttgctactcttcagttaaatcttcttttcttaagaattaattttcaggataaactttaaatgttctttataattttttcatttgttaacattagaatggtgtgatttcttctgatttttcattcggaaattcaatattctatgtagaggttaaataggattttgtaagtcagctctcctgagacttcatgtttgtaaaactgtctgtgtatcccacaaaactgatacaaacaaactcgcagcacaactcctgagatgtttgatgaataaaaaattaaaactgt

SEQ ID NO: 105342 - DNA, 2478 bp, Homo sapiens
  Payload ID: 666
  Gene Symbol: AK9
  Gene Name: adenylate kinase 9
  ENST ID: ENST00000368948
  CDS Start-End: 83-2293
atagagaggtcgggtagaggctcccgggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaatatctgaacctaaaaagagcagctattctaaccaaacttcagggtgcagaggaagaaattaatgacacaatggaaaatgatgagctatttcgtactcttgcatcttataaacttattgcaccaagatacagatggcaaagaagtaaatggggacgtacatgtcctgtgaatttaaaagatggtaacatttattcaggattaccagattattctgtgagttttctaggtaaaatctactgtctttcatcagaagaagcattaaaaccatttttgttgaacccacgtccctatctgcttccacctatgccaggaccaccatgtaaagtattcatacttggacctcaatattcagggaaaacaacactttgcaatatgcttgcagaaaattacaaaggaaaggtagtcgactatgcccaacttgttcagccacgttttgataaagcccgtgaaacattagtagaaaataccatagctgaggccactgcagcagcaattaaagttgtgaaagaaaagcttctcagggaactgcaagctagaaaacaagctgaaacagctttaagagaatttcaaaggcaatatgaaaaaatggagtttggagtattcccaatggaggcaacacactcatcaattgatgaagaagggtacattcaaggctcccaaagggacagaggcagctctttagtggacaccgaagaagccaaaacaaagtcagaaaatgtcctccatgatcaagctgctaaagttgataaagatgatggaaaagaaactggtgaaacattcacatttaaaaggcattctcaagatgctagtcaagatgtaaagttgtattcagatacagccccaacagaagacttgatagaagaggtaactgcagatcatccagaggttgtgaccatgattgaagagactataaaaatgtcacaggatataaactttgaacagccatatgaaaaacatgctgaaatcttacaggaagtccttggagaggtaatggaagaaaacaaggataggtttcctggtgccccaaaatatggaggctggattgtggacaactgccctattgtaaaagaattgtggatggccttaatcaagaaaggaattatacctgatttggtcatctatttatcagatacagaaaacaatggaaaatgtttatttaatagaatatatttacagaagaaatctgaaattgactctaagattttagaaagattattagaagaactacaaaagaaaaaaaaagaagaagaagaagcaagaaaagccacagaagaggaattgagactcgaagaagaaaatcgaaggctactggaacttatgaaagtgaaggcaaaaggcaagcacagattgctatgactgatgatgtgtcatggtattgttactgcaagcaattgcagtatttcaagtgaattatagactgggtgatcacatttcccaatttgtccatgagagcccaggtttatgcctatattcttgaagtctttatagtaccttttattcttaaagtgttccagtttgtatactaaataatattgttactg

SEQ ID NO: 105343 - DNA, 831 bp, Homo sapiens
  Payload ID: 666
  Gene Symbol: AK9
  Gene Name: adenylate kinase 9
  ENST ID: ENST00000448084
  CDS Start-End: 150-831
agttgcttccctgaggagggtccggctgcggccagggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaatatctgaacctaaaaagagcagctattctaaccaaacttcagggtgcagaggaagaaa

SEQ ID NO: 105344 - DNA, 6326 bp, Homo sapiens
  Payload ID: 666
  Gene Symbol: AK9
  Gene Name: adenylate kinase 9
  Uniprot ID: Q5TCS8
  ENST ID: ENST00000424296
  CDS Start-End: 78-5813
gaggtcgggtagaggctcccgggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaatatctgaacctaaaaagagcagctattctaaccaaacttcagggtgcagaggaagaaattaatgacacaatggaaaatgatgagctatttcgtactcttgcatcttataaacttattgcaccaagatacagatggcaaagaagtaaatggggacgtacatgtcctgtgaatttaaaagatggtaacatttattcaggattaccagattattctgtgagttttctaggtaaaatctactgtctttcatcagaagaagcattaaaaccatttttgttgaacccacgtccctatctgcttccacctatgccaggaccaccatgtaaagtattcatacttggacctcaatattcagggaaaacaacactttgcaatatgcttgcagaaaattacaaaggaaaggtagtcgactatgcccaacttgttcagccacgttttgataaagcccgtgaaacattagtagaaaataccatagctgaggccactgcagcagcaattaaagttgtgaaagaaaagcttctcagggaactgcaagctagaaaacaagctgaaacagctttaagagaatttcaaaggcaatatgaaaaaatggagtttggagtattcccaatggaggcaacacactcatcaattgatgaagaagggtacattcaaggctcccaaagggacagaggcagctctttagtggacaccgaagaagccaaaacaaagtcagaaaatgtcctccatgatcaagctgctaaagttgataaagatgatggaaaagaaactggtgaaacattcacatttaaaaggcattctcaagatgctagtcaagatgtaaagttgtattcagatacagccccaacagaagacttgatagaagaggtaactgcagatcatccagaggttgtgaccatgattgaagagactataaaaatgtcacaggatataaactttgaacagccatatgaaaaacatgctgaaatcttacaggaagtccttggagaggtaatggaagaaaacaaggataggtttcctggtgccccaaaatatggaggctggattgtggacaactgccctattgtaaaagaattgtggatggccttaatcaagaaaggaattatacctgatttggtcatctatttatcagatacagaaaacaatggaaaatgtttatttaatagaatatatttacagaagaaatctgaaattgactctaagattttagaaagattattagaagaactacaaaagaaaaaaaaagaagaagaagaagcaagaaaagccacagaagaggaattgagactcgaagaagaaaatcgaaggctactggaacttatgaaagtgaaggcaaaagaagctgaagagactgataatgaggatgaagaggagattgaaggtgatgagttggaagttcacgaagagcctgaggcatctcacgatacccgagggtcatggttacctgaggagtttgaagcatctgaggtccctgaaactgagcctgaagcagtatctgagcctatcgaggaaactacagtggaaacagaaatcccaaaaggatccaaagagggcctggaaattgaaaaattatctgaaacagttgtactacctgagtttccagaagactcttatcctgatgttcccgaaatggagccatttaaagagaagattggttctttcatcatcctctggaaacagctagaagcaacaattagtgaggcttacattaaaattttaaacttggagattgctgacagaactccacaggaattacttcaaaaagtagttgagactatggaaaaaccatttcaatatactgcatgggagttaactggggaagattatgaggaagaaacagaagactaccagactgaagcagaggttgatgaggagctagaggaagaggaagaggaagagggtgaagataaaatgaaggagagaaagaggcatttgggagacacaaaacacttttgtccggtggtcctcaaagaaaacttcatcctgcaaccaggaaacacagaagaagcagccaagtatcgagaaaagatctactacttttcaagtgctgaggctaaagaaaagtttttggagcatcctgaggattatgtggctcatgaagaaccattgaaggctcctccattaagaatatgccttgtcggcccccagggctctggcaaaactatgtgtggaagacagttggcagaaaaattaaacatttttcacattcagtttgaagaagttcttcaagaaaaactactactcaaaactgaaaagaaagtgggacctgaatttgaggaagattctgagaacgagcaagctgccaaacaagaacttgaagagcttgcaattcaggccaatgtcaaagttgaggaagaaaatacaaaaaagcagcttccagaagtacaacttacagaagaagaagaagtaatcaaatcaagtctaatggaaaatgagcccttgcctcctgaaattcttgaagtaattctttctgagtggtggcttaaggaaccaatacgttccacaggttttatattagatggtttcccacgatatccagaagaggcccagtttttgggagatcgtggatttttcccagatgcagctgtttttatacaagttgatgatcaagatatttttgatcgcctccttcctgcccaaattgaaaagtggaaactaaaacaaaagaagaaattagaaaggaagaaactgatcaaagacatgaaggcaaaaatcagggttgatacgattgctaaaagaagggctgaacttatattagagagagataaaaaaaggagggagaatgttgttagagatgatgaagagattagtgaggaagaacttgaagaagacaatgatgatattgaaaacatccttgaagatgagtttccaaaagatgaggaagagatgagtggcgaggaagatgaagaacaggaaactgatgcaattgagcgcctgagaggtgaactaggagaaaaatttgaagcagatacacataatttacaaataatacaggatgaacttgagaggtatttgataccaataatttccattaatggagctcggagaaatcacattgtacaatatacattgaatatgaaactgaaaccactggtggaaaatcgtgcaagcatttttgagaaatgtcatccaataccagcaccccttgcccagaaaatgctcacctttacctacaagtatataagctcattcggctattgggaccctgtaaagctaagtgaaggagagacaatcaagccagttgaaaatgcagagaatccaatttatcctgtaatccatcgtcagtatatttattttttatctagtaaagaaacaaaagaaaaatttatgaagaacccaatcaaatatatccgccaacccaaacctaagcctactgtgcccattaggattataattgtggggcctccaaaatctgggaaaactacagttgccaaaaaaattacaagtgaatatgggttaaagcatttatcaataggaggagctttgcgttatgtactaaacaatcacccggaaacagagctggcacttatgttaaattggcatcttcataaaggaatgacagcacctgatgaactggctattcaagccttagaactttctctgatggaaagtgtgtgcaatactgcaggtgttgtcatcgatggatatcctgtaactaaacatcaaatgaatctcttggaagctaggtcaatcattcccatggtcatctttgaattgagtgtgccttccaaggagattttcaaaagattgctcctagaaaaagaaaatgaacaaagattgccttatccattgcacaatagtgcacaaattgtagctgtcaataatgtaaagtatcgcaaaaatattggtgagattaggcaatattatcaagaacagcatcagaactggtatgtgattgatggatttcacagcaaatggtgggtatggaatgaagtcattaagaatgttcaaatggtgaataaatacatgcagacatacctggaaagaataaaagcaggaaaagctgcctgcattgacaagttatgtatcacacctcaagagctgctttctcgcctgggagaatttgaacagttctgccctgtcagcctggcagaatcccaggaattatttgattgctctgcaactgactccttggaatttgcagcagagttcagggggcactactataaaatgagttctcaggaaaaactgaataaattcttggagaacccagaattgtacgtgcctcccttagcacctcatccactcccatctgctgacatgatccccaaaagactgacactgtcagagctgaagagtcgattccctaagtgtgcggagctccagggctactgtccagtgacctataaggatggaaaccaaagatatgaagctctagtacctggtagcattaactatgctttagaatatcataatcgtatatatatttgtgagaacaaagaaaaactccagaaatttttgaggtcgccactgaaatactgggaacagaagcttccacacaagcttcccccattaagggaaccgatacttcttactagtcttcctttgcctggatatctggaacagggtattgcaacttctctaattaaagcaatgaatgcagcgggatgcttaaagcccaagttcccctttttaagtataaggagatctgcactgctatatatagcacttcatctcaaagcatttaatcccaaaggttccgaatacacaagaaaaaagtataagaagaagatggagcagtttatggagagttgtgaactcataacatacttgggtgccaagatgaccagaaaatacaaggaacctcagttcagagccattgactttgatcataagttaaagacctttctctctctcagaaatatagacccaattaatgggtagtttacttaggtgatagcagcctgaatctcaagagttatctgaaagtgatagagggaaactgagagaagtagattgaaaatctgggcctcttggaagtacttttgcctcctgagcaaggtaccatggctgccagacttcaggtgaactcaaaggtctgccagccaggaaggagcactcttatggaaacaagttttaatacaattttaaaatgtattgctctttgcctgaactttgatgctttaacaaaataaacattctatttataattccatatagaaaagttaagtgacttatttaataaatgtattattttcctttttaacattttcagtagaaaagtcagtctctgttaaaattactcattaaatgttagaaagctttaagacatttaacattgttataaatgaaaccaaaatatgggttatacattttacatacaaaactgtttgtgaactttgtgaacataagatactatcattttcccaataaaataaatggattttgcaacaactt

SEQ ID NO: 105345 - DNA, 1561 bp, Homo sapiens
  Payload ID: 666
  Gene Symbol: AK9
  Gene Name: adenylate kinase 9
  ENST ID: ENST00000491875
  CDS Start-End: 1-656
aagttgaggaagaaaatacaaaaaagcagcttccagaagtacaacttacagaagaagaagaagtaatcaaatcaagtctaatggaaaatgagcccttgcctcctgaaattcttgaagtaattctttctgagtggtggcttaaggaaccaatacgttccacaggttttatattagatggtttcccacgatatccagaagaggcccagtttttgggagatcgtggatttttcccagatgcagctgtttttatacaagttgatgatcaagatatttttgatcgcctccttcctgcccaaattgaaaagtggaaactaaaacaaaagaagaaattagaaaggaagaaactgatcaaagacatgaaggcaaaaatcagggttgatacgattgctaaaagaagggctgaacttatattagagagagataaaaaaaggagggagccaaacaaggagaagagaaaaagaggaatatcagaaaatacaacttgctacaagtgcaaccacatgtcaccctggtgtgaatatgctggacttccgtacagaggactgctgatattgtacagtgcaactgcaactgcaactgcaggcacaaagcattgcagaagcggggccaaagtaattgttgctttgtcaaaacaaaatattcacaaccaaaagtagataagaaaaaaccattggactgagaaaattatggcaccatgtaagaataagaaccctcctcttaattatttgcctcgattttcattcatttattcattcagtccatcagcaaacattaattgagctttgtgtctgacactgtttcaaatactggcaaatcagccatgagcaaaacttacagaaatcgtagcctcattataatgctcatttctctcatcaaacatgttctgaaagtttgctctgtttaaggtgtcatgctaatgtttaggatcaaaaagatgtcctaacctggaattaagtacagttaactactttaagcccttgggagtccctagtggtccccttctgaatcacttcaaatgtttcagcagtgaaggagtccaggctttgcagttaaacacacctacgcagtatcccttctccagttctcactgactttgttcactgctctccagtgcctggtggagtgctgacacatgtgacattcaacttcagttgtttcgctgaggttgtataacattgagtaagtcacttagcctctgtaaacctagggctttttattgtaaaatgggaaaaattaatacatttagtttccctaattaataataatttaatttccctttgctactcttcagttaaatcttcttttcttaagaattaattttcaggataaactttaaatgttctttataattttttcatttgttaacattagaatggtgtgatttcttctgatttttcattcggaaattcaatattctatgtagaggttaaataggattttgtaagtcagctctcctgagacttcatgtttgtaaaactgtctgtgtatcccacaaaactgatacaaacaaactcgcagcacaactcctgagatgtttgatgaataaaaaattaaaactgta

SEQ ID NO: 105346 - DNA, 2759 bp, Homo sapiens
  Payload ID: 666
  Gene Symbol: AK9
  Gene Name: adenylate kinase 9
  ENST ID: ENST00000470564
  CDS Start-End: 1-2249
cccaaattgaaaagtggaaactaaaacaaaagaagaaattagaaaggaagaaactgatcaaagacatgaaggcaaaaatcagggttgatacgattgctaaaagaagggctgaacttatattagagagagataaaaaaaggagggagaatgttgttagagatgatgaagagattagtgaggaagaacttgaagaagacaatgatgatattgaaaacatccttgaagatgagtttccaaaagatgaggaagagatgagtggcgaggaagatgaagaacaggaaactgatgcaattgagcgcctgagaggtgaactaggagaaaaatttgaagcagatacacataatttacaaataatacaggatgaacttgagaggtatttgataccaataatttccattaatggagctcggagaaatcacattgtacaatatacattgaatatgaaactgaaaccactggtggaaaatcgtgcaagcatttttgagaaatgtcatccaataccagcaccccttgcccagaaaatgctcacctttacctacaagtatataagctcattcggctattgggaccctgtaaagctaagtgaaggagagacaatcaagccagttgaaaatgcagagaatccaatttatcctgtaatccatcgtcagtatatttattttttatctagtaaagaaacaaaagaaaaatttatgaagaacccaatcaaatatatccgccaacccaaacctaagcctactgtgcccattaggattataattgtggggcctccaaaatctgggaaaactacagttgccaaaaaaattacaagtgaatatgggttaaagcatttatcaataggaggagctttgcgttatgtactaaacaatcacccggaaacagagctggcacttatgttaaattggcatcttcataaaggaatgacagcacctgatgaactggctattcaagccttagaactttctctgatggaaagtgtgtgcaatactgcaggtgttgtcatcgatggatatcctgtaactaaacatcaaatgaatctcttggaagctaggtcaatcattcccatggtcatctttgaattgagtgtgccttccaaggagattttcaaaagattgctcctagaaaaagaaaatgaacaaagattgccttatccattgcacaatagtgcacaaattgtagctgtcaataatgtaaagtatcgcaaaaatattggtgagattaggcaatattatcaagaacagcatcagaactggtatgtgattgatggatttcacagcaaatggtgggtatggaatgaagtcattaagaatgttcaaatggtgaataaatacatgcagacatacctggaaagaataaaagcaggaaaagctgcctgcattgacaagttatgtatcacacctcaagagctgctttctcgcctgggagaatttgaacagttctgccctgtcagcctggcagaatcccaggaattatttgattgctctgcaactgactccttggaatttgcagcagagttcagggggcactactataaaatgagttctcaggaaaaactgaataaattcttggagaacccagaattgtacgtgcctcccttagcacctcatccactcccatctgctgacatgatccccaaaagactgacactgtcagagctgaagagtcgattccctaagtgtgcggagctccagggctactgtccagtgacctataaggatggaaaccaaagatatgaagctctagtacctggtagcattaactatgctttagaatatcataatcgtatatatatttgtgagaacaaagaaaaactccagaaatttttgaggtcgccactgaaatactgggaacagaagcttccacacaagcttcccccattaagggaaccgatacttcttactagtcttcctttgcctggatatctggaacagggtattgcaacttctctaattaaagcaatgaatgcagcgggatgcttaaagcccaagttcccctttttaagtataaggagatctgcactgctatatatagcacttcatctcaaagcatttaatcccaaaggttccgaatacacaagaaaaaagtataagaagaagatggagcagtttatggagagttgtgaactcataacatacttgggtgccaagatgaccagaaaatacaaggaacctcagttcagagccattgactttgatcataagttaaagacctttctctctctcagaaatatagacccaattaatgggtagtttacttaggtgatagcagcctgaatctcaagagttatctgaaagtgatagagggaaactgagagaagtagattgaaaatctgggcctcttggaagtacttttgcctcctgagcaaggtaccatggctgccagacttcaggtgaactcaaaggtctgccagccaggaaggagcactcttatggaaacaagttttaatacaattttaaaatgtattgctctttgcctgaactttgatgctttaacaaaataaacattctatttataattccatatagaaaagttaagtgacttatttaataaatgtattattttcctttttaacattttcagtagaaaagtcagtctctgttaaaattactcattaaatgttagaaagctttaagacatttaacattgttataaatgaaaccaaaatatgggttatacattttacatacaaaactgtttgtgaactttgtgaacataagatactatcattttcccaataaaataaatggattttgcaacaa

SEQ ID NO: 105347 - DNA, 1032 bp, Homo sapiens
  Payload ID: 666
  Gene Symbol: AK9
  Gene Name: adenylate kinase 9
  ENST ID: ENST00000490722
  CDS Start-End: 1-937
tcacagcaaatggtgggtatggaatgaagtcattaagaatgttcaaatggtgaataaatacatgcagacatacctggaaagaataaaagcagagctgctttctcgcctgggagaatttgaacagttctgccctgtcagcctggcagaatcccaggaattatttgattgctctgcaactgactccttggaatttgcagcagagttcagggggcactactataaaatgagttctcaggaaaaactgaataaattcttggagaacccagaattgtacgtgcctcccttagcacctcatccactcccatctgctgacatgatccccaaaagactgacactgtcagagctgaagagtcgattccctaagtgtgcggagctccagggctactgtccagtgacctataaggatggaaaccaaagatatgaagctctagtacctggtagcattaactatgctttagaatatcataatcgtatatatatttgtgagaacaaagaaaaactccagaaatttttgaggtcgccactgaaatactgggaacagaagcttccacacaagcttcccccattaagggaaccgatacttcttactagtcttcctttgcctggatatctggaacagggtattgcaacttctctaattaaagcaatgaatgcagcgggatgcttaaagcccaagttcccctttttaagtataaggagatctgcactgctatatatagcacttcatctcaaagcatttaatcccaaaggttccgaatacacaagaaaaaagtataagaagaagatggagcagtttatggagagttgtgaactcataacatacttgggtgccaagatgaccagaaaatacaaggaacctcagttcagagccattgactttgatcataagttaaagacctttctctctctcagaaatatagacccaattaatgggtagtttacttaggtgatagcagcctgaatctcaagagttatctgaaagtgatagagggaaactgagagaagtagattgaaaatctgggcctcttggaa

SEQ ID NO: 105348 - DNA, 577 bp, Homo sapiens
  Payload ID: 666
  Gene Symbol: AK9
  Gene Name: adenylate kinase 9
  ENST ID: ENST00000524674
  CDS Start-End: 1-577
ttatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatggatgagctatttcgtactcttgcatcttataaacttattgcaccaagatacagatggcaaagaagtaaatggggacgtac

SEQ ID NO: 105349 - DNA, 988 bp, Homo sapiens
  Payload ID: 666
  Gene Symbol: AK9
  Gene Name: adenylate kinase 9
  ENST ID: ENST00000532976
  CDS Start-End: 211-988
ataaatgccaaattaggtacaaaagtgactatttcgaattggaaaagaaatgacaaagaactacagccccgcctctcgaggccccgccccaccaagcagcaggtgcgtggcggccagaggtctccccggcaaccgcccgacagccccgcggagtccctggaggcagttgcttccctgaggagggtccggctgcggccagtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacaca

SEQ ID NO: 105350 - DNA, 411 bp, Homo sapiens
  Payload ID: 666
  Gene Symbol: AK9
  Gene Name: adenylate kinase 9
  ENST ID: ENST00000605986
  CDS Start-End: 1-411
ctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagttcagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatggtgagtgcagtgttaagcaggaatacttcacagcatggaaaatttaaatctattgacagtattgtacttcttttaataaacagaagcatatttatatttgaacaccatt

SEQ ID NO: 105351 - DNA, 1620 bp, Homo sapiens
  Payload ID: 667
  Gene Symbol: ADSL
  Gene Name: adenylosuccinate lyase
  ENST ID: ENST00000216194
  CDS Start-End: 32-1528
cagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactagtctcattctgtcaaggggcgtgatcaaggcttattgcaacctccgcctcccaggctcagacagctctcctgtctcagtctcccaacttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgtta

SEQ ID NO: 105352 - DNA, 1808 bp, Homo sapiens
  Payload ID: 667
  Gene Symbol: ADSL
  Gene Name: adenylosuccinate lyase
  Uniprot ID: P30566
  ENST ID: ENST00000342312
  CDS Start-End: 57-1334
tttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaaaaaaaaaaaaa

SEQ ID NO: 105353 - DNA, 754 bp, Homo sapiens
  Payload ID: 667
  Gene Symbol: ADSL
  Gene Name: adenylosuccinate lyase
  ENST ID: ENST00000624503
  CDS Start-End: 42-425
ttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgtaggcgcctgtgttgtttatacttaaaactcagtctctagaatctatttgtcaattttatttgatgttgtccagttgaggaagtgacactatagatcttttttttttttttgaggcagagtctccctctgtctcccagactggagtgcagtggcacggctcactgcaagctccgcctcctgggttcacaccattctcctgcctcagcctcccgagtagctgggattacaggtgtgagccactgcccctggcctccaaatgctttctttagtcttaaatgaaacataattaaaggcatctttgtgtaactggcgagtcagatagtgggagaagaacagtcttcttacttggaaaat

SEQ ID NO: 105354 - DNA, 732 bp, Homo sapiens
  Payload ID: 667
  Gene Symbol: ADSL
  Gene Name: adenylosuccinate lyase
  ENST ID: ENST00000624027
  CDS Start-End: 1-245
agcgtatccaggttgatgcctacttcagtcccattcactcccagttggatcatttactggatccttcttctttcactggtcgtgcctcccagcagtgtaagcaagtgccattggacaagaacgttgtctgtgtcattccttgttgtatttccaatagcaagagcacatcagatacttggcaactaggcagtcttccagcttctgccactgcgcccgacttccttgttgcatggatttatagctgattgaagcaactgtagccaaagattgagttaattacctacctgccaggagagcactagtgttatttagcccattctcatcctacatatttttcggcatagatgaaaatgaaagcttttgtttatcagatttgcagatgacacaaaactgggagaattaacaagtatgtttatttggtaaaataagttttcatctctaacctaaatcggctgaaatgatgtgtcctaaactagaggaaaaagttaataaagatcaatgtaaataagttaatcttaaactcagtatgcaccagaactgagagaagactgttttaggaggtgttaatggttgtccagtgcccaaaaagccaccagaggcttactgctccgcactcttggcattacattcaattttggatacccagtctgaggaatagagatgaactggagagccaacctccaaaaagatcttgtggtggaggaatgttagggctctttatcctatacagaa

SEQ ID NO: 105355 - DNA, 678 bp, Homo sapiens
  Payload ID: 667
  Gene Symbol: ADSL
  Gene Name: adenylosuccinate lyase
  ENST ID: ENST00000624474
  CDS Start-End: 28-522
ccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaaggcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatac

SEQ ID NO: 105356 - DNA, 847 bp, Homo sapiens
  Payload ID: 667
  Gene Symbol: ADSL
  Gene Name: adenylosuccinate lyase
  ENST ID: ENST00000623632
  CDS Start-End: 60-847
aggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagat

SEQ ID NO: 105357 - DNA, 1079 bp, Homo sapiens
  Payload ID: 667
  Gene Symbol: ADSL
  Gene Name: adenylosuccinate lyase
  ENST ID: ENST00000625194
  CDS Start-End: 1-1079
gatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaagttgagtggagacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtc

SEQ ID NO: 105358 - DNA, 856 bp, Homo sapiens
  Payload ID: 667
  Gene Symbol: ADSL
  Gene Name: adenylosuccinate lyase
  ENST ID: ENST00000623287
  CDS Start-End: 30-479
gtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacc

SEQ ID NO: 105359 - DNA, 728 bp, Homo sapiens
  Payload ID: 667
  Gene Symbol: ADSL
  Gene Name: adenylosuccinate lyase
  ENST ID: ENST00000423176
  CDS Start-End: 1-308
agcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaagtgtaagcaagtgccattggacaagaacgttgtctgtgtcattccttgttgtatttccaatagcaagagcacatcagatacttggcaactaggcagtcttccagcttctgccactgcgcccgacttccttgttgcatggatttatagctgattgaagcaactgtagccaaagattgagttaattacctacctgccaggagagcactagtgttatttagcccattctcatcctacatatttttcggcatagatgaaaatgaaagcttttgtttatcagatttgcagatgacacaaaactgggagaattaacaagtatgtttatttggtaaaataagttttcatctctaacctaaatcggctgaaatgatgtgtcctaaactagaggaaaaagttaataaagatcaatgtaaataagttaatcttaaactcagtatgcaccagaactgagagaagactgttttaggaggtgttaatggttgtccagtgcccaaaaagccaccagaggcttactgctccgcactcttggcattacattcaattttggatacccagtctgaggaatagagatgaa

SEQ ID NO: 105360 - DNA, 713 bp, Homo sapiens
  Payload ID: 667
  Gene Symbol: ADSL
  Gene Name: adenylosuccinate lyase
  ENST ID: ENST00000480775
  CDS Start-End: 1-236
ggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagtccttcgggaacagagaggagtcggagtaagatactctgcaggagctctttgggaggatgcgctggtcttcagctcagccacagcacacctaagagctcatctccttcatcagcctagtcacagctcccagactctactgcacactgacagtgtggggtgatgcttattcccctacctcccccagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaaacggatctgtttggccgaggcatttcttaccgcagatactatattgaatacgctgcagaacatttctgaagga

SEQ ID NO: 105361 - DNA, 712 bp, Homo sapiens
  Payload ID: 667
  Gene Symbol: ADSL
  Gene Name: adenylosuccinate lyase
  ENST ID: ENST00000623978
  CDS Start-End: 312-712
agtccaccctggcggggtcgcagggttgggatggcggctggaggcgatcatggttcgcccgacagctaccgctcacctcttgcctcccgctatgccagcccggagatgtgcttcgtgtttagcgacaggacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgaccct

SEQ ID NO: 105362 - DNA, 4359 bp, Homo sapiens
  Payload ID: 667
  Gene Symbol: ADSL
  Gene Name: adenylosuccinate lyase
  Uniprot ID: P30566
  ENST ID: ENST00000623063
  CDS Start-End: 60-1514
aggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgacttgattattcttagaaatgcacttgacctgcttttgccaaagcttgccagagtgatctctcggcttgccgactttgctaaggaacgagccagtctacccacattaggtttcacacatttccagcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtagagcagcttgacaagatggtgacagaaaaggcaggatttaagagagctttcatcatcacagggcagacatatacacgaaaagtggatattgaagtactgtctgtgctggctagcttgggggcatcagtgcacaagatttgcaccgacatacgcctcctggcaaacctcaaggagatggaggaaccctttgaaaaacagcagattggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccgacggatctgtttggccgaggcatttcttaccgcagatactatattgaatacgctgcagaacatttctgaaggattggtcgtgtaccccaaagtaattgaacggcgcattcggcaagagctgcctttcatggccacagagaacatcatcatggccatggtcaaagctggaggtagccgccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaaaaaaaaaaaaagaaccaaaccctgatgtgaccatcaggctgattgagctgaagttgtgcccaagctcatttcatcttttgataaggcttatacagcagggaaatgctaattgagtatattgatttcatcagggccgctgacagtctttattccttgttgcatggattttgttgttgaggcttgctctgtcacccagactagagtgcagtagcacaatcttggctcactgcaacctccgcctctcaggttcaagcgattctccagcctcagcctcccaagtagctgggattacaggcgcctgccgccatgcctggctaatttttgtatttttagacgggatggagttttgccatgttgggcgggctggtcttgaactcctgacctcaagtgatccgcccatctcagcctcccaaagttctgggattatagacatgagccaccacacccagcctaatcttgttttctttttttacttgtttacagtgtaagcaagtgccattggacaagaacgttgtctgtgtcattccttgttgtatttccaatagcaagagcacatcagatacttggcaactaggcagtcttccagcttctgccactgcgcccgacttccttgttgcatggatttatagctgattgaagcaactgtagccaaagattgagttaattacctacctgccaggagagcactagtgttatttagcccattctcatcctacatatttttcggcatagatgaaaatgaaagcttttgtttatcagatttgcagatgacacaaaactgggagaattaacaagtatgtttatttggtaaaataagttttcatctctaacctaaatcggctgaaatgatgtgtcctaaactagaggaaaaagttaataaagatcaatgtaaataagttaatcttaaactcagtatgcaccagaactgagagaagactgttttaggaggtgttaatggttgtccagtgcccaaaaagccaccagaggcttactgctccgcactcttggcattacattcaattttggatacccagtctgaggaatagagatgaactggagagccaacctccaaaaagatcttgtggtggaggaatgttagggctctttatcctatacagaagaaaactcctcggcacttcaaatattgccaggtgcaggaagagtgacttgattgtgtgttgccccaagagacacactgagctcaatacccattactgagactggcttggggccagacattggaaccactgagattagcaacctacactcaatcccccaggtcaggcagaagctggaagactgcctcgttaggaatgttgtgagggagaggaggctgaatcggttccagttttatttaaaagtagccaggaaatcaggttgcgatgatgcgcatttacagtcccagctacttgggaagctgaggcgatagggtcacttgagcccaagagtttagtccaggctgggtgacagcgagcccttgtcacttaaagccaacctaagagaagagcttatccttttggaaaaacaatagaagacaattctgaaaaccaaattctgaacataggctagtatagcaagcaagcagggatagcatagagccatttgctcaacttccagaaagagttactctgttcatctctaaaaaatcttgaaaagggccgggtgcggtggtggctcacgcctgtaatcccaacactttgggaggccgaggcaggtggatcacctgaggtcaggagttcgagaccagcttgaccgacaaggtgaaactccgtctctactaaaaatacaatcaaccgggcgtggtggcaggcgcctatagtcccagctacttgggaggctgagacaggagaattgcttgaacctgggaggcagaagttgcagtgagccaagatcatgccactgtactccagcctgggcaacggagcgagactccatctgaaaaaacaaaacagaaaaaatcttgaaaggatactaagtctgacacaaggaaattaagtcatgggactctgaccagatattctgtctacttccttctctgctatgggcaacttggaggcagcaactactatcagtttatctgtaatgtgagaatttatattacataacagatactggggatataggataccatggattttagttaatacatttcctcatagaaaataaggaaataacagtcttgttcctgtcctaacaattctgttagactaatgatctccagtgattggcgatttgacctggtttcttcctggactatttgaatgggtggatttgttggtgcatctcttgtcttctttccttttccattctcctttatttttgtatttacatacttgtatgcaactttgtaatctgattttcccatgtaacattttaatttga

SEQ ID NO: 105363 - DNA, 2780 bp, Homo sapiens
  Payload ID: 668
  Gene Symbol: ADSS
  Gene Name: adenylosuccinate synthase
  Uniprot ID: P30520
  ENST ID: ENST00000366535
  CDS Start-End: 318-1688
acgggagtggcgcgccaggccgcggaaggggcgtggcctcggtccggggtggcggccgttgccgccaccagggcctcttcctgcgggcggtgctgccgaggccggcctgcgcggggcagtcatggtacccccttgagcgggctgtggcggagagcggggcggggactggctggagggtggcggcccggcggggcgggggcggggccggcctctggctccttcttcctctgcatgtggctggcggccgcagagcagttcagttcgctcactcctcgccggccgcctctccttcgggctctcctcgcgtcactggagccatggcgttcgccgagacctacccggcggcatcctccctgcccaacggcgattgcggccgccccagggcgcggcccggaggaaaccgggtgacggtggtgctcggtgcgcagtggggcgacgaaggcaaagggaaggtggtggacctgctggcgcaggacgccgacatcgtgtgccgctgccagggaggaaataatgctggccatacagttgttgtggattctgtggaatatgattttcatctcttacccagtggaataattaatccaaatgtcactgcattcattggaaatggtgtggtaattcatctacctggattgtttgaagaagcagagaaaaatgttcaaaaaggaaaaggactagaaggctgggaaaaaaggcttattatatctgacagagctcatattgtatttgattttcatcaagcagctgatggtatccaggaacaacagagacaagaacaagcaggaaaaaatttgggtacaacaaaaaagggcattggcccagtttattcgtccaaagctgctcggagtggactcaggatgtgcgaccttgtttctgactttgatggcttctctgagaggtttaaagttctagctaaccaatacaaatctatataccccactttggaaatagacattgaaggtgaattacaaaaactcaagggttatatggaaaagattaaaccaatggtgagagatggagtttattttctatatgaggccctacatggaccaccaaagaaaatcttggtagaaggtgcaaatgcagcactattagatattgattttgggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgaaattggagaattattacaaacaaggggtagagagtttggtgtaactactggaaggaaaagaagatgtggctggttggacctcgttttgctcaaatatgctcatatgatcaatggatttactgcgttggcacttaccaagttggatattttggacatgtttacggaaatcaaagttggagttgcttacaagttagatggtgaaatcatacctcatatcccagcaaaccaagaagtcttaaataaagttgaagttcaatataagactctcccaggatggaacacagacatatcaaatgcaagggcgtttaaagaactacctgttaatgcacaaaactatgttcgatttattgaagatgagcttcaaattccagttaagtggattggtgttggtaaatccagagaatctatgattcaactcttttaatgattgccagtaatgcaagaaacactccttgagagggaggggaaaagactttcttaaatatttcatttatgacctgcaaattcaagaataaagacactgaagtaagtttgaagccctacagttgtttccagtcttttcagatggatgcctactgtggagattaactttggcatattccagtgtcagctttctttagctggaattgccaaatcatttgttgctcctgctgctctcatggtgccacgttttttttttcaatgtttagtaatagtataatccatgttgtttgatatcaaaagtagaattacttttaatgtagtttttcttcattattgtcattgcgtgttcttaagttttacccctattagatggtaagaacaattaatgcagttttgcacaaatatttttacattctgatcattcagttctgtcattgtaatctttgttgttagaaacaaatgatgaaaacataggggttctgtaaacttttgtaatgctatgaattctgtttaaattttgggctgtctattttctgctgaaaccatgcaaaattgagctttggtggggctgggagggggttatgtattcatgggacctttaatttgtacagaacacagaacttatttctgtcagttatttaatacattgaaaatttagtgaaatgttcaaagagaatagatgtttcccaaaacaacaatctttatgttaaaaatagtcattaaaagatctgttgtaatatatggtggatatttttctttaatttcaaacattacctctgaaatgtgtatcttttcttttttatcttaccattaattttaaatctagtggattggttttcaacatcgtgcctgccgatatgcctacagaatcatctgtaagtgtcaaaatgaacccacgttgttagccataattttgattatgcctttatttctcctttcttgaaaaaaaaaaggtgttattttgacaattaggcataacattgttttgtagattatcttttaatgaactattttaaatgttaaattaggtgccacttaaatttattttattacaccatgaatagctgattaaaagaaccaaatatttctagta

SEQ ID NO: 105364 - DNA, 1766 bp, Homo sapiens
  Payload ID: 669
  Gene Symbol: ADSSL1
  Gene Name: adenylosuccinate synthase like 1
  Uniprot ID: Q8N142
  ENST ID: ENST00000330877
  CDS Start-End: 86-1459
ccccggcccggctccatttaatggcgcggacgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 105365 - DNA, 1969 bp, Homo sapiens
  Payload ID: 669
  Gene Symbol: ADSSL1
  Gene Name: adenylosuccinate synthase like 1
  Uniprot ID: Q8N142
  ENST ID: ENST00000332972
  CDS Start-End: 160-1662
ggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttgtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 105366 - DNA, 520 bp, Homo sapiens
  Payload ID: 669
  Gene Symbol: ADSSL1
  Gene Name: adenylosuccinate synthase like 1
  ENST ID: ENST00000555674
  CDS Start-End: 192-416
cctgcttaccacccaacactgagaaaatcaaactgggccacgtgcccacttgctgccttccttgcagctgagtccctaggcaaggaggccctggatgggggtggccgtgtcaccaaatatccgcttccctggtgataggaggtctgtgggccccactcatctcctgtgtgcttcccccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtgtgtatcataacagtcttttctgctctctcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaa

SEQ ID NO: 105367 - DNA, 1791 bp, Homo sapiens
  Payload ID: 669
  Gene Symbol: ADSSL1
  Gene Name: adenylosuccinate synthase like 1
  ENST ID: ENST00000553540
  CDS Start-End: 1-681
atggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgagattggaggcctgctgcagacccgcggccacgagtggggagtgaccacaggcaggaagaggcgctgcggctggctcgacctgatgattctaagatatgctcacatggtcaacggattcactgcgctggccctgacgaagctggacatcctggacgtactgggtgaggttaaagtcggtgtctcatacaagctgaacgggaaaaggattccctatttcccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactg

SEQ ID NO: 105368 - DNA, 652 bp, Homo sapiens
  Payload ID: 669
  Gene Symbol: ADSSL1
  Gene Name: adenylosuccinate synthase like 1
  ENST ID: ENST00000556623
  CDS Start-End: 154-345
gcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaa

SEQ ID NO: 105369 - DNA, 1012 bp, Homo sapiens
  Payload ID: 669
  Gene Symbol: ADSSL1
  Gene Name: adenylosuccinate synthase like 1
  ENST ID: ENST00000555486
  CDS Start-End: 1-546
ggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcatggggggcaacaacgccggccacacggtggtggtggatgggaaagagtacgacttccacctgctgcccagcggcatcatcaacaccaaggccgtgtccttcattggcaacggggtggtcatccacttgccaggcttgtttgaggaagcagagaagaatgaaaagaaaggcctgaaggactgggagaagaggctcatcatctctgacagagcccaccttggagactcaggccagcaggaggtgaggtccatgtatacacatctgtcctctgcttctctcctgtctcctgctgccctcacctggcccgcccgacagtgtttgattttcaccaggctgtcgacggacttcaggaagtgcagcgccaggcacaagaggggaagaatataggcaccaccaagaagggaatcggaccaacctactcttccaaagctgcccggacaggcctccgcatctgcgacctcctgtcagattttgatgagttttcctccagattcaagaacctggcccaccagcaccagtcgatgttccccaccctggaaatagacattgaaggccaactcaaaaggctcaagggctttgctgagcggatcagacccatggtccgagatggtgtttactttatgtatgaggcactccacggcccccccaagaagatcctggtggagggtgccaacgccgccctcctcgacattgacttcgggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaa

SEQ ID NO: 105370 - DNA, 2383 bp, Homo sapiens
  Payload ID: 670
  Gene Symbol: AJAP1
  Gene Name: adherens junctions associated protein 1
  Uniprot ID: Q9UKB5
  ENST ID: ENST00000378190
  CDS Start-End: 695-1930
cacgccccgcgctccacggcgccctcgccccgcgcgcctctcgtgcccgcctcctgccagtctccgggccgcggccgtctgcagagcgagcgctcagacggagcccccgggcaacttgagtggcgccgatcggcggcggagcctctggcagagccccccgacccggcagcgcggaggggactcgcgtccgtccgcgtcgcgtcaccccaaaccctaagcagcgccgccccatcggcgcggagctccggctggaggcaagagccgcgcgccgggagacacgcaccgtgagcggcagcgccgccggcctccctcctcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcagctccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggcggttgtccggaatgccagtggctcctgggcagatgtgcaccccagattcagcctttgtgatagattccaacacgttctggcctcagaccacctttgtggtggggccagactgctctgggcaaagtgaagctggcctttatgctccaaggaagggggcctcgagagcaggcctgcattggctctcggactaattcgcgatcatctttcatacagcaggtacacttcagcaaacctcgttaatgttgatctctttccctttgccaaggccgcttcgttctgaacggagcctgcaaagtcataaaagctcttgaatccgaagcaagtgagaaataaatcatgcactattattattttcaaaaacacattgatcactaataaaaaataagaagtgt

SEQ ID NO: 105371 - DNA, 11666 bp, Homo sapiens
  Payload ID: 670
  Gene Symbol: AJAP1
  Gene Name: adherens junctions associated protein 1
  Uniprot ID: Q9UKB5
  ENST ID: ENST00000378191
  CDS Start-End: 382-1617
tcgccgccccggagggcgaagccgcggctccccagccctttgctgcgccgcgacagcgccggaacacgccccgcctcgctgccgccttcgctgtgccgccggcggagggggccgcgagccccgcgccccggccggaggatgtgcgcccccgcgggccgcccagcctgagccatgcgccccaacggcggcggcgcgccggccggcatggagccccgcgcggccgcgctctgactcgctgtgcgccccgcggccggcgggcggcgggaggcggcggaccgagagccggagaccggcgccgcgggacggaagcgagcgggcgcgggcgccgcgcagatggcctgggcgagccaggtctgaggccccgctccccgaaacgtgaccatgtggattcaacagcttttaggactcagctccatgtccatccgctggccgggccgccccctcggaagccatgcctggatactgatagccatgtttcagctcgccgtggacctgcccgcctgtgaggccctgggcccggggccggagttctggctcctgccgcggtcgccgccccggccgccccggctgtggagttttaggagtggacagccagcgcgggtcccggccccggtgtggagcccccggccgccccgagtggagcggatccacgggcagatgcagatgcctcgagccagacgggcccacaggccccgggaccaggcggccgccctcgtgcccaaggcaggactggccaagcccccagctgctgccaaatccagcccttccctcgcctcttcgtcctcgtcctcgtcctccgcggtggccggtggggccccggagcagcaggccctcctgaggaggggcaagaggcacctgcagggggacggtctcagcagcttcgactccagaggcagccggcccaccacagagactgagttcatcgcctgggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccaccagtcccagcaacaacggggaagtcacccagcccccaaggattctgggggaggcctcaggtctggctgtccatcagatcatcaccatcaccgtctccctcatcatggtcatagctgctctcatcacaactcttgtcttaaaaaattgctgtgcccaaagcgggaacactcgtcggaacagccaccagcggaagaccaaccagcaggaggagagctgccagaacctcacggacttcccctcggcccgggtgcccagcagcctggacatattcacggcctataacgagaccctgcagtgttctcacgagtgcgtcagggcatctgtgcccgtgtacaccgatgagacgctgcactcgacgacgggggagtacaaatccacatttaatggaaaccgaccctcctcttctgatcggcatcttattcctgtggccttcgtgtctgagaaatggtttgaaatctcctgctgactggccgaagtcttttttacctcctgggggcagggcagacgccgtgtgtctgtttcacggattccgttggtgaacctgtaaaaacaaaacaaacaaaacaaaacaaaaaagacaaaacctaaaactgagctatctaagggggagggtccccgcacctaccacttctgtttgccggtgggaaactcacagagcaggacgctctaggccaaatctatttttgtaaaaatgctcatgcctatgggtgactgccttctcccagagttttctttggagaacagaaagaagaaaggaaagaaaggaaccagaggcagagagacgaggatacccagcgaaagggacgggaggaagcatccgaaacctaggattcgtcctacgattctgaacctgtgccaataataccattatgtgccatgtactgacccgaaaggctcggccgcagagccggggcccagcgaatcacgcagagaaatcttacagaaaacaggggtgggaatctcttccgatagagtcgctatttctggttaatatacatatataaatatataaatacaaacacacacacacactttttttgtactgtagcaatttttgaagatcttaaatgttcctttttaaaaaaaagaattgtgttataggttacaaaatctgatttatttaacatgcttagtatgagcagaataaaccagtgttttctactttggcaactcacgtcacacacatattacacacatgtgcgcattacacacacacaatacacatacatgcatatagacgcatctattggaaatgcagttccacaggtgagcatgttctttctggtgacctggtattccatcaccattcaccccaggggacagcctcgaccgagacaaggaggcccttaaatgacagcctgcatttgctagacggttggtgagtggcatcaaatgtgtgacttactatcttgggccagaactaagaatgccaaggttttatatatgtgtgtgtatatatatatatatatatatatatatatatatatatatgtttgtgtgtgtatatatatatatatatatatatgtttgtgtgtgtatatatatgtttgtgtatatatatacacatatgcatacatatgatttttttttttcatttaagtgttggaagatgctacctaacagccacgttcacatttacgtagctggttgcttacaaacgggcctgagcccctggttgggtgggtggtggattcttggacgtgtgtgtcatacaagcatagactggattaaagaagttttccagttccaaaaattaaaggaatatatccttatgatgtgtgtgtgtaatatcagggcagaacttagacatacgtgaagggccccggttggtttgaaaacgaaaaatagtcattctgtgtgcaaaccacaaggctgccccagtcaggcagcgccctgacctggcctgtgctgcattgccttcccttgcgcaggtgggcaggtgtggcccgctttttctagggcccaagggtgacttggaatcttgggggaagcctcggcaaagatgccgttctcccgtcagcttccattggccgatggatgtttctgttttgtcaccgagaatcctactataaactacccagtggaaacaggggccccagacctgagcctcagtacagagaatcccaaccacacacactttattaaaaatactgccatgccgccgggcctccctcacaagcctcacctgaaacgggctcactggtgccccagacttgctgtcaacagcgggtgctgtagggatctagggatgcatctcatggcccacgctgtgcctccttaaaggatgtttcctgtccatgggagacgcctaacatggtgtgggtccctgtctccaaagactatatttctcacgcgtggcccacgtgcagctttaatttcagcagtagagtgcatgagccaattcagtgaaatgtcacaggccaggcaaaaaggttaaagatcagacagacagctgaccttactgccctcaatggccaggctgatgacctgattcttcccttgggctcagtctccctctaaaacaccttgtgatatgcttcagaagttcacttttgtatctcctgaaacatgtgaacctagagtaaggcctccggaggtgaaaggattgtttttgtgatgcagcagtgttgagatctgtatccatggtattgctcacaaattaggaaaagttgttctttagtttttgttctgtcatttattttccccccaagctttggcacatcctgagacaatgcaaacatccgccactggcatttggccgtctccaggttcctggcactcacctgcatggcgctccagcctgcagctctctctgcgcgccatccggcctcgtccatcccattctccttcaatcactccctcccgctgaggtgggcctcctgactccaggtgagcacagcgtggtgcgagtgcatggtgagggctggcggcggccaacaggcagtggggtggctgctctggtctctgacattctgagctccagagtgagcccaactaaggaggaggtgacggccggggggccctgttggttcgctgatcatgagaacctaggattcccgagggactcctggtatctgctctgtcaactcccagctgctcagcccccttctctgaccatgtgcggcaccctggatgccctgaactctttcctgggtccataagacatcgagccttggaaggaagcgtaatgcaacaaccctcttgtccccgataagagccacagattcaaggcagggctgtgagacccacacaggcacaaacaccagacaagcaagtgcatgcccattccacacccaaaagtctggttctgtaccaacatgacatccgtcaaggtaaatccacacaaaggctgctatttctggatgattgaggcagtgtctgtagacgtgttactttacttttttaaatggttacctgctctcccagacccctcacctgggattgtcgtctaggtaagaggagataatgagtgaaagtgactgggcctcggaaatgcagccccacccacggtgaagtctgcaccagagcacagacttgtcctacttcgggccatatgtataggtaatgcccatgtactttgtgtgtcggtggctgctgatttggcctgatcagtccttctgcagccttggggcagtgtttcaagctagttggtgtcctctttcctctgcttgacccctggaattcagagtctaatagtagacacctcccatcccccacccaaggcctggtcctttcctttgcttgagcttttattcctcaagaaaagaactccaaggaagggtgatgtggtttgttagggttccccagttttcgtccacttccatcttattcctcggagatcccgcaattgcaaaccccctggcagcctcctggcacctgcatttgcctttaaagcttagaaacagctgggaatgcactccttgtacagtccagtccgttttcagacaaagtcgctgctagtcttcacacgcttgatgtcactttgtctgattggaatatgcgtgtcattgctcttgtttccgagtttggcgtgagaaaggcagggttctccaggcatggtcagggagcttccccaccgtttcccattgggctcagattccagccattaccgagacaaatccaagccttctcacgcaacgtggaagcgtggtgacaccctggggtgtgtggaggtggctgctagtgttcctatttactgccctccttgcacacagaagggagaggccacttaggggaccttgtcttctccgtagtatttctagtccttgccaatcttgaacttgagtggacttctcatattacattcagctcccagaaattcactccagtccttcctggagcattgtgaaattagaaacctgaactcatcagcaaaccccacccactctttgaatcgggacaccaggaaacccgttactactaatgtgatcttaccatcttaatcctttctttcaaaaatacgtgactctttcacagccatattttagcgtcaggaaaagccatgcttagagggattggtcttcaaaattttgtgtgtgatgcccaatgtgtaggccatattgaaaggtgaacgcaccaaaggatcgaccctgtcaccttggatggtctctattttgaccctgttgcccatggagaggtattttacccttttgcttctttgctcaggtggtccagggttgtctgtagcccaggaagcggactgaccctgtatcttgaaagataagaccaggaaccgggagtgaggctgggactctcactcagccttttcacggtcagtcttggtcttctcatacttatttcaagatggcaccaggacacaccttcttttgtccacctgttgacaccatcaccctctttcatcaaggtgatctctttcatcagggcatatatgagacttggtgctccaccagactgtcttctcccctacccctgccccttccacaaagccatttctcaagtcgcagtgggaaaagataccaagacacctgatttcttgaaccattcttgcttcagcatgtgaattctttaagacactactcacatatgccattggagagaaacaacccgttctgcatcaccataatgaaccgatcagtcattcatcctcttattcaacaaatacttgttccacttctaccacactggccatacagttggaggcaagatgggcacagttatggccttgtgggctttatattctacagtgggaggaggtggatggttaatgtgaaagcaaaccaaaataatttccagagagagaagaggcaggaagagagcagagcagagtgatggggctgggggcagagaaggagagaggggaagagggagagagtggggggcattgaaggggaagaaagagaggcaggggttgtctacgtctcctcctcctgcgacccatcacctactggaaaattaccacttgctgcttgagggttggtctggtgttggatggaggaagaaggccttagtcttagctcttggataaaatgcagtgcagcactgaagataagacatcgcagttgttacgacgcctggttctccaccaaattcctctgtcattccagcaagagtggaagcagaggggcaggggcaggggcaggatgagggctgctgccctggtgatgagcttgccccatccctgggcactggctctgcccagcccctcccatgttggtcccatctgtcaggttgccaggccaagcaggtctcaggtcagccaggtctcaaggaggataagggggttcaacgtcagcgacttggcccacggggcacgggcaccttggggatgccattcttcttggtgccagaaggcagctgcatctccagaagctcccccagcactgagctcacttagtggcatccttcttaaacagcatctgcttttaagtaagcagctattccaaaacatgccgtgattcatgtaatttttgagtggttactttggtgcagtttgtcaatttgctctaccatactgttttttgattatttgtttgttttctagtgtaaatagcacagcccacataaatgagcgaaactcatcatctgaggatctttgattattcttccccacttattgtacattgatgtgccgcctgctaggaagataaactccctctttgctcactctgagccaggatctctgtgttagttacactcagccttatctgagcattccagggaggtcttaaatgaatgtttggggttttgaaacatgctaccagcccttccttccaaagagcatgaagcatggctctgtgtggttttgtgtgtctaggtttagagcttgtatttggatgtaaggagtgactaaaaacaggtctaggcagagaactgctatcttttaaaccaccccagccctcagtcgaacagaaagaatgagcgtcttctgatgtcaaatcattctagaaaggtcttagctagtgagcacaaagtagccaatcccgggagtttatatgggcctccatgtgaccaagccatccctagctaggaaacttaactctttgcacaacctccctttatgctgaagggcccttgggaacatgggaacatttgcactttgtcagaggagtggccccaccctactctctgcctgaaacacaaagcagctcccctcagaacagccagcccggtgcagaagcacttgaacttctcatcttccatcttatttcactttggttgcagggagttaaatacataggccacagcagactaagggagcggtgtgcacaatggcccccagaatatccagtgacccaagtgatgttagtcttagggtccctaaggcagtagggcatggggaggaaagttctctccatcgattcccaaacacaccagccacaagtccacactccacacctgtaaacgcacagcccatgccccattgtaaaggtgactgaagagaatggtcaactcggtggtgatgggcctgttttggagctaaaagcataaaatgaatcctccctgtagctccattgccttttcctcgtgaaggattccctgctaaatgttctaagagttactgtacatagaatcaagagagcagttttgaatgagccgtaaatctgagtcatatataagaggcataatataaattgggccaagcttgcccatgtgggacacacaggtttatagagattaaacactagtgagtagcgggggaagggaacagtgactgtataaatggccatataaatgacctacttgtcttctcatgtaggctggaatcagaacctacgtatgctgtagataacagtcaattaaatgggttaatgttctaagccaagagagttctaagccaagacatgtgcttgggactggattaactcttgtcaatatcttggattccatagtaaaacatctgttaagtaacatgcggcaggaaaggatgcagggagcattggactgtaggaaattctcctttatacaagttaattagttttgtctctggtggctgtctcttaaaacagaatcccctggagacccgggttttcattttgtaattcaacacccaaatatttgcaacactaaataacaactccctaaagacttcagtcttgcatgggcataagcaactcacactggttagcttttgtcagatttcgtcgtttccgcagcaaaatttcttagtgttgatgttgatagcttctgggttggcaaactggcagttcactctagtcttactgggttgggcaagtccttgcccctagaaaattggggatagctttggccatgggaggagcaagaacactacgcagtcgtaagctctgttttttgttttgttttgttttgttttgttttcggcaccattatgtacgatgaagacttacagccactgctaatacagcataggggacactttgaggagccctagtatcattgtttgaaatcattgtacagggaactgcaggggtgaacaccattgtaccaatccccgggccagtgtctcatttcctaacagaatcatcccattcttgttcactcttcagtcatcccaagccaaaagggaaaattcgaaacccactgtgacaccccaaccctaatttccaacctttggaggactcacctggggcagaagggagaaagggctttgctgaagtctcaggctgccgagagccatgtatgggcataggagcaagctgatggcatggctcttgacaaggttttctatagggcagcagctgctgctcccaggggaaccctctcctgttgcctccgcagtctattctggggtggaaacaccattctctattatttctctcacatacatgtggatttctaatatcaagttatgtgactgcctaccacttaaggcctacaaaaccacatgggagtttctttattgcgtatgcagccagtcaacatgaatgggaccctagaaactgtgaggagcaggattctctaaggtgctcttagatacggtgtcacttccacatacaagcacaattctcccagttaaggggctggaagacaagcggggcaactggttttgaaaagcccgctggcgtgccagagggggtgtttgcccacaccctccttgaatttaactgccacaatctatccgcagatgtgttttgttctatttcttgtttttcactagcgtttgcgttgcttcctctgaagccagagggtgaaaggccctagcaaagttagttatcagtcaactgatgataactgtgatccttaaagatgaattcccagcctgaggtgacacacagaggttcagcagacgtctcaggatctgtcatatgtcatgttgcttggtgtgaagatggaagaacaaagtccacatcagtttctgctccttcaaacagtgtgtcgatatgaaacattgagatttggcagaaacatgtgcctagtttgcagcaccaaatactggtcttctcagaagtgtttctgtttttttgtttttgtttttgtttttgtttttgtttttgttttgtttaatttcctcttctggcatcccaatttggatcatttcctctctttctttcctggagaaacaggatggcaggtgctggagcccagagagggggtcaccctccagctaaaatgatttaaatggaaaggagaatgacagcaaagcctcacgtgaactttaatgaccttatcaatgacctttactaactgactcttggtacccggattgttgagaggtgagtgggactaaaagccaggatcaagatcaggttgctccacacatttgcagatcaggaaccccgggaatatgagttagacccagaaagtattgaactggacattgaatgaagcttgaggccatgcattgataacatttttagagtctgttacattattttctcaaaaggaacacatgtttactacaaaccatttagaaaataccaataaccaaacagaagggaaatgtctggaaccttccagttgtttaattctgtagaaactgttcacgaaaggctgaatgagtggggacaagtcacagagatctcgccatggttagcaccagggacaagtctggctctaatgtatgttttatgaagtctgattagctttgaaatgcatctttgccagctgaacttgtcatgcactaaacttcccattgatcattagagtgtctacgattaagtggaaaaggtggtcaaccatttggatgtttgactttcacaacatcaagcattggccattgggcgtatctgggcattggtatggaataaacaggatactcagtgaaacatccaaactattgactggatttttcccatggggcatctgtctaagagtcacagatctgagaaatagaaggaccaggtccgtgtggatgctcctagtgcgttcaaataacccttgaattcaccaggtctcattgcatttatttaaagatggagcccattgtcccccctcctcctcagctcacccatggaactagaaattcacaaacctgaagctgaaccacaggacaagaaattaaacagcaacggccacatggcctcttttttcacaggttttgcattgaatgttttagaactttattcccccgccccctcacccatgtataccaaaactggttttattttcattttcctaaattattttctgatacaataaactgttaactgtttatttatacttttacaaggagcacttgttatttttcaaaaggaaaacaaaagcctctctgttttcatgttctccgtatatctataccacagctgtctctatagacgtatttatatatcatcttcttgagagagttaacctcctgtagtttaatgttgtgtttcttttctttaaatgcatatcataatcatgttaataaacaaaaatgacacaatatatgtgggtggggggcggggggcaggtggctgggtgtgatttccgtacaggtgaacttttattccagatttttttaagttgtttctgtatttcaaagctatgtatttggaaaacattgtaaatgaaacacctatattaactttcctgtgtatatttagtactctgatgttgctattaaaaaaaaaaacataatatgaaaaaaaaaaaaaa

SEQ ID NO: 105372 - DNA, 3438 bp, Homo sapiens
  Payload ID: 671
  Gene Symbol: ADGRA1
  Gene Name: adhesion G protein-coupled receptor A1
  Uniprot ID: Q86SQ6
  ENST ID: ENST00000392606
  CDS Start-End: 130-1521
cccgtggggggctcatcctacccacagtaagagcatcctggcgtgaccccactgaggacttcacctcctctcccttggtggacacctatccaggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtt

SEQ ID NO: 105373 - DNA, 4283 bp, Homo sapiens
  Payload ID: 671
  Gene Symbol: ADGRA1
  Gene Name: adhesion G protein-coupled receptor A1
  Uniprot ID: Q86SQ6
  ENST ID: ENST00000392607
  CDS Start-End: 437-2119
gtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcagatgggagcagctcccggactgcgcccgccccgccgcggtcaccctgaggccaggggcccgggagcgcgacctcctggccgccgtctgggactttgaccttccagaggccatggaggctggcggggagcagggcgccacctgatcgcctccccctggacgcctcctccagcggcgctcacgcttccgcaactttgcagcgctcatggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcgtactgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactga

SEQ ID NO: 105374 - DNA, 6004 bp, Homo sapiens
  Payload ID: 671
  Gene Symbol: ADGRA1
  Gene Name: adhesion G protein-coupled receptor A1
  Uniprot ID: Q86SQ6
  ENST ID: ENST00000607359
  CDS Start-End: 1-3840
atgcgaggccacgggaaccactcgcggctgaaatccagatgtgcttctctgggcaacgtccatcaccaccaggcacagatggcgcacggtgcacactgccgagggggccggacaccacagtcaccagacagccggggcccaaccgctgggggccacacccggggcagatggacgtaccggcccatcgaggccctcatcaacgtcagctttcccggagcaaagggtgggagaacggccgagggcgagccctcatgggcgtgggtcttcagaagtggctatttgcagagacaggctcttcctgggcttcccgtctccacccgagtggctgcctgctggtggcaacaccatccaggcagggactcagggttcttgggacctggatttattgacctgctcagagaggagcccagcggccgtgcagatgggaaggcagctgctcagaaaacagggcgtctttatttgttcccgactttcctaggcaacaaattaccagaggccgccgactcgtttggggaaattgcttctgggaacagtgttatttttacctccgtcttgcaatcctctcacccacctggcaccccaccgcccagcgcacgcaagccaagtcccggagctgccatgctcgtctgtgaggaaacgctggagctgggtgcccagggctgctgggggtccacgagcccccggggccaggccgtgagcttggtcggtgggcccacggccggaggctccaggctgggaggggctggctgcaccatgggcctgctcatggccctccaggccagacgccccagggacggcacctgggctgaccctcgaagatgctccagggctgtggagggctcgggcctcaccagggctgcccttgtgagtccagggccatcgggggtggaggaggacaccaggagggaaggctgcgtgcttgtgggctcctggaggtcgtccacccacagaagccgtgttctgattatcaacacgccctctggcaggaccccctggagccagggctccctcggcagcaccgggcgctacaaccagacccgggcaccaggcagccagcagcaggggctgtgctcggatgcagctctacacgaggattttgtgccggagcctactcctgccttctttcaataccctccacaagccttcagcaaaaccaaggttcgcgacttggggaggggaggcctttatgccttttccaaggaggagaaggtatctgaggcccagcgggtagaggcctacgagacccacggccttggcctgagtacaggccgacagaaccctgtgccgtccccctgtaagcctggatgcgtgtgccagggccttgcgctggacgcagaggcctggccgaggcaccctggacgcaggccctgtgcggccaaggaggcctgcctgggcccacctggctgcagcggggagctgagcctccctgaggaggaaggaatcgcacctggggcagcaacagcagctcctgcctgggtccctcatggccgcgtgagccgcttcctcactgtaaagctcttcacctatgtaactatgtatcaatgtaaacaggaacgtatcctccgcctctgcatctctggtgaatccgggcgatacgtgcggcgctcacgcttccgcaactttgcagcgctcatggtgagtacgggggtcccgggggtcctgcagctgggggctaggccgctgcgggggggcggccacccgtatggggactcccaggctggaaaagttgtggaatggcgagctggtgaccgggcttccgggctcagtgccggggaaagaaggttcctcagccagtcggagctgcagacctggccccggacacctcactgtgtaggaaagaaggttcctcagccagttggagctgcagacctagccccggacacctcactgtgcaggaaagaaggttcctcagccagtcggagctgcagacctggccccggacacctcacccgcagggaggaagattccttcaggcagctggcattccccaggtttgaagaggtcactttcccacctctcactgctgcagaaagagcaccctctgtccacggtggacactctctagccagccagggcctcgtcttggctggacggacaagaagtgtggcctcaggagggaagcaggagctctcgggcccgctggctgcctgcatcccgacacaggatctgaagacagtgctctccctgccccgctacccaggggagttcctgcaccccgtggtgtacgcgtgcacggccgtcatgctgctctgcctcctggcctccttcgtcacctacatcgtgcaccagagcgccatccgcatcagccgcaagggccggcacacgctcctgaatttctgcttccacgcggccctgaccttcactgtgttcgccggcggcatcaatcgcaccaagtaccccatcctgtgccaggcggtgggcatcgtgctgcactattctacactgtccaccatgctgtggataggagtgaccgccaggaacatctacaagcaggtgaccaagaaggcccctctgtgcctggacacagaccagccaccgtaccccaggcagcccctgctcaggttttacctcgtcagcggaggggtcccctttatcatctgtggggtcacggctgccacgaacatcaggaattacgggacagaggacgaggacacggcctgctggatggcctgggagcccagcctgggcgccttctacggcccagccgccatcatcaccctggtcacctgtgtgtacttcctgggcacctacgtgcagctgcggcgccacccagggcgcaggtacgagctgcgcacacagcccgaggagcagcggcggctggcgacacccgagggcggccgtgggatccggccaggcaccccacccgcacacgatgcccccggcgcctccgtgctgcagaacgagcactcattccaggcacagctgcgcgccgccgccttcacgctgttcctgttcacggccacgtgggccttcggggcgctggcggtgtcacagggccacttcctggacatggtcttcagctgcctgtacggcgccttctgcgtgaccctgggactcttcgtgctcatccaccactgcgccaagcgtgaggacgtgtggcagtgctggtgggcatgctgcccgccccgcaaggacgcccaccccgcacttgacgccaacggggccgcgctgggccgcgccgcctgcctgcactcgccgggactgggccagccacggggcttcgcgcacccaccgggcccctgcaagatgaccaacctgcaggccgcgcagggccacgccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgccccttccttgtgatcacacccctgccccttccttgtgatcacacccctgccccttccttgtgatcacacccctgccccttccttgtgaaagacctcagcggggaaacgctccgggccacgcccactccccttatcccaattccgcgtgctggtcccgcacacggtcatccggtttctgtcctgtggtctccagtcctggggcaccctagaggcagagcaggggattccatcaaaggacccactgagaccccagcatggccctgcccgagatgccctgctgcccacggagtcctggcttcccctggtgtggccgggcagggccgagatcgcaggagggggctgccctgacctttcccagtgttcaatgtgtgtgtcttgcgttctactccgggggtggcggcggcaggtctgtccccagcattctcgctctgggcagaaccctcgggaccctccgctgtcgtgtgtctgagccacccctgcagcttcacagggcccctgcacacctctgcccactcagtgtgccctgtcagccctgtccttgtcgtagccccagccctgcagggctgagagcaccacagatgctgggggctgctctggactttggggatggctgtcagcctcagagggccaatggggggctttcacgggcccaaggcttgggaaaatgcccagacatcctttagtgaagactcgacttccaaaaccagccaccgctgggactggattccactccagtataggcacttagcaacacgaaggtttattccaaaaagaaaaggggctgacagacgggagattctcatggacaaaatccctttccctttttctcgtctccatgaacatctgggtaccaagccctgactcaaaggacagatgtggatgacagcaagacttctgtgaaagcaagtggcccgtccctaggtgggagggagtccagagggtcatgggtgtgaaactgtgcacagctttccctccctccctcttcctccttgtctgtgacacatgtgcacccacacacacacacacaaacacatgtgcatatcacacacatgcacacacacaaacacatgtgcatatcacacacgcgcacacacccaaacacgtgcatatcacacacatgcacacacacaaacacgtgcatatcacacacatgcacacaaacgtgcatatcacacacacgcacacacacccaaacacgtgcatatcacacacacgcacacacacaaacacgtgcatatcacacacaaacacacgtgcacacatacttaacacacacttgcacctgctgtgcacatgtgcacacacacgtagtagtgtgttttccagccacccacacactgggtttgcattggagattgtttcaccctgcaaacgtcaacgtcagcagactcgtcggtgcgctgtgctatccggttgggaggtctcaccaggagcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacaggtcgaccagacgggccgtcggaggaccaccaggtggctctgcctctgcctcaccttctcacctgcttccatagctgatgtgaacccgaatccccacgctgtgctgtgtacgcactgtaggtgcagaaccgtccacacaaaaatacagtcttggcattgtttgttctttgtgaggctggttaatagcatccccgtgtgtttttctcaccctcgatggggtagaggggcacctgaatgtgtggcccccgtctgtgtcctggatcctggggcagggctgctctccctggcccctgcagcccctcatgaactttccaccctcagtgcccccggctgagcagagaggcgtcccaccattcaaccaaagaaagtcaacattgaacattaaacctctgtgtgtttctatactga

SEQ ID NO: 105375 - DNA, 6270 bp, Homo sapiens
  Payload ID: 672
  Gene Symbol: ADGRA2
  Gene Name: adhesion G protein-coupled receptor A2
  Uniprot ID: Q96PE1
  ENST ID: ENST00000315215
  CDS Start-End: 364-3729
gcggcggcagcaggagcccggcgcgatccgctaggtcccagcccagcgcccagcgagcaggcgacgcggaggggccgggcctccagtgtcccgagggccgggcgctgagactccggccgcgcagctgggagctgcccgcgctgcgctgacagccgcgccgacgtcctccccgccggggcgctcgcaggacatgcccccggggcgcggcggcggggaccccggggctcgcctccgcccagggcccccctccacgccctcgggagccccgggcccccgctgagcactcctcccgcacgcctgggtccctccggccggcgcgcagcccggccccagcgctgtgggtccccgcggggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggagggccccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggcagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactgccttagtctacccactgtccttttgttatgaggtagaggatctcatgacaccatacacacaaacccatcattgcctgtgaatgcacgtagggccagaattccccagttcccgctcctctgagggttgatactgctgggaatgccaaccactccacaagcagagggaagccccctcaggcctgcaggaggagccgcagcagtgtgtccaattcaaaccagcagcaaagagcctgacattttcccatccatctatgaggaaagccatctcacagaacatggacataggcaacttgctctcccacaccaagggatgggaatctctcctacctatagtcatccctgcactcctgactttactccaggacccagggtccaactaatggcagagcccctcttggttccttcaaacaagaaaagcaatacctacggactggtgtacacttccatccttggttataacaggaatgttatcaagctgtcagaacaggatgaagtgctcccagtggatatccatcagggagggttagggacactcgtggcagcctgtctagcagcctgggctctctgaaagtccctaacttcctgaggggtacgcaaatactgttctatttcactatcagaaatgttctcatctccagtgacagtggagacagggggtacagggcagatccgcttcggggacttcaacatgcagggtggcaagagaagggcaggactggccggccgcttcccctggggtaaacctaaggaattatttcccacctccccttctccttgcccctgtccccaccccggtggctccttctctcgggtctccacttctgctgtcccatcccgaaaggcagagcggaccagtgactggcggtgctggagaaggtcaccgatgtgcttcaccacagaccgtttgtcaagtctcagaa

SEQ ID NO: 105376 - DNA, 571 bp, Homo sapiens
  Payload ID: 672
  Gene Symbol: ADGRA2
  Gene Name: adhesion G protein-coupled receptor A2
  ENST ID: ENST00000428068
  CDS Start-End: 1-571
agagccgctgtgcagggcctggaaccccggccagcccatctctcccttggctgtgtggctgccttcctctactggtttccccgggagcatctcctgcatggaggaaaagggaaggtgccctcctatttgggatgccttgggctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctcc

SEQ ID NO: 105377 - DNA, 5651 bp, Homo sapiens
  Payload ID: 672
  Gene Symbol: ADGRA2
  Gene Name: adhesion G protein-coupled receptor A2
  Uniprot ID: Q96PE1
  ENST ID: ENST00000412232
  CDS Start-End: 14-4030
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggagggccccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggcagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctactg

SEQ ID NO: 105378 - DNA, 4566 bp, Homo sapiens
  Payload ID: 673
  Gene Symbol: ADGRA3
  Gene Name: adhesion G protein-coupled receptor A3
  Uniprot ID: Q8IWK6
  ENST ID: ENST00000334304
  CDS Start-End: 271-4236
ggcggcggcagaggaggaggaggaggcggtgctcgcgccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgttattgtgtcg

SEQ ID NO: 105379 - DNA, 2870 bp, Homo sapiens
  Payload ID: 673
  Gene Symbol: ADGRA3
  Gene Name: adhesion G protein-coupled receptor A3
  Uniprot ID: Q8IWK6
  ENST ID: ENST00000502482
  CDS Start-End: 214-2064
gggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccacccggacgccggcggggccgcgcgcagccgccgctgttgctgccgctctcgctgttagcgctgctcgcgctgctgggaggcggcggcggcggcggcgccgcggcgctgcccgccggctgcaagcacgatgggcggccccgaggggctggcagggcggcgggcgccgccgagggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggtatgttacattctgcaatcatttaagactatttacagttaaattagaatgctccaaatgttctgcttcgcaaaataaccttattaaaagattttttttttgcaggaagataggtattattgcttttgctactgttttaaagaaaactaaccaggaagaactgcattacgactttcaagggccctaggcatttttgcctttgattccctttcttcacataaaaatatcagaaattacattttataactgcagtggtataaatgcaaatatactattgttacatgtgaaaaaatcttatttgacttaaaagtttatttatttgtttttttgctcctgattttaagacaataagatgttttcatgggcccctaaaagtatcatgagcctttggcactgcgcctgccaagcctagtggagaagtcaaccctgagaccaggtgtttaatcaagcaagctgtatatcaaaatttttggcagaaaacacaaatatgtcatatatctttttttaaaaaaagtatttcattgaagcaagcaaaatgaaagcatttttactgatttttaaaattggtgctttagatatatttgactacactgtattgaagcaaatagaggaggcacaactccagcaccctaatggaaccacatttttttcacttagctttctgtgggcatgtgtaattgtattctctgcggtttttaatctcacagtactttatttctgtcttgtccctcaataatatcacaaacaatattccagtcattttaatggctgcataataactgatccaacaggtgttaggtgttctggtttagtgtgagcactcaataaatattgaatgaatgaacgaa

SEQ ID NO: 105380 - DNA, 1572 bp, Homo sapiens
  Payload ID: 673
  Gene Symbol: ADGRA3
  Gene Name: adhesion G protein-coupled receptor A3
  Uniprot ID: Q8IWK6
  ENST ID: ENST00000508133
  CDS Start-End: 29-1174
atttctgtaatcatctgatactcttaggatgccactgaagaggaataactctaaataccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaaggggaaattccggtgaatatggaattagaagaagagaggttagaagccaagaaaaagattgtacaataaattcttcaactatggaatgtttttagatggttaattgttcacttctttggtatatatatattttttactgaatgctgaataatttgttatttaaaaatcctcaataaagaaatctgaaaaaattcagtgatcagtcagcattttcagttgttcctatgtgttattattttttttttctaaatgtgtttcctagtctcaaggaaatttctgctaagtgtactgaatctaaacctctattatgtttgtataatttcattcttttgttgtgtggaggtttgaattcatcataaatcaccttaaagttccataagcccaaattaattatactcatatttatgatatgct

SEQ ID NO: 105381 - DNA, 682 bp, Homo sapiens
  Payload ID: 673
  Gene Symbol: ADGRA3
  Gene Name: adhesion G protein-coupled receptor A3
  ENST ID: ENST00000511051
  CDS Start-End: 213-317
ttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctagctgtacagcagtcatgacgctggcatctgcttggcttctggggagccctcgggaaacttacaatcatggcagaaggtgaaggagaagcagtgtccattctccagtatggttttgggggagtatggcttcctacctactgcggaccacctgtcaactctgggctgtaacatgagagaattgtgaacttctgtcttgtttgagccatggtttcattctctttttcagccatgtagcctgtgctgtaactcagtgccacattagcaactagtgaaagtcaatgtgggtaaatttgtcattcttcaggttagaacatttcttccttttattcttgtgtttttggctaaataaactgggaaattatagta

SEQ ID NO: 105382 - DNA, 733 bp, Homo sapiens
  Payload ID: 673
  Gene Symbol: ADGRA3
  Gene Name: adhesion G protein-coupled receptor A3
  ENST ID: ENST00000514129
  CDS Start-End: 443-733
gagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccagaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttc

SEQ ID NO: 105383 - DNA, 5527 bp, Homo sapiens
  Payload ID: 674
  Gene Symbol: ADGRB1
  Gene Name: adhesion G protein-coupled receptor B1
  Uniprot ID: O14514
  ENST ID: ENST00000323289
  CDS Start-End: 184-4938
ggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaaccc

SEQ ID NO: 105384 - DNA, 5903 bp, Homo sapiens
  Payload ID: 674
  Gene Symbol: ADGRB1
  Gene Name: adhesion G protein-coupled receptor B1
  ENST ID: ENST00000521208
  CDS Start-End: 646-4125
gcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaagctgctgctggtggccacaggctggcaccagggccctggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctgggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaaccc

SEQ ID NO: 105385 - DNA, 6241 bp, Homo sapiens
  Payload ID: 674
  Gene Symbol: ADGRB1
  Gene Name: adhesion G protein-coupled receptor B1
  Uniprot ID: O14514
  ENST ID: ENST00000517894
  CDS Start-End: 895-5649
gatgtaatccgtaatgcagtctctggctcccgattcgggatccagtttcagagagcgagagattggggagcgccggcagccgggtggggggaagcagctctcgcctctctcctcctccttctcctcgtcctcggcctcctcctcctccccgcgccgccccgcccccggctcggcttggctcgcccccccccccccctcgccaggaaggggaaaaaaggcgagaagagccgggcaggcgagaggagcggagcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaagctgctgctggtggccacaggctggcaccagggccctggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaacccatc

SEQ ID NO: 105386 - DNA, 5400 bp, Homo sapiens
  Payload ID: 675
  Gene Symbol: ADGRB2
  Gene Name: adhesion G protein-coupled receptor B2
  Uniprot ID: O60241
  ENST ID: ENST00000373655
  CDS Start-End: 343-5097
gccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 105387 - DNA, 5414 bp, Homo sapiens
  Payload ID: 675
  Gene Symbol: ADGRB2
  Gene Name: adhesion G protein-coupled receptor B2
  Uniprot ID: O60241
  ENST ID: ENST00000373658
  CDS Start-End: 355-5112
ttttctgcacccgccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgg

SEQ ID NO: 105388 - DNA, 4675 bp, Homo sapiens
  Payload ID: 675
  Gene Symbol: ADGRB2
  Gene Name: adhesion G protein-coupled receptor B2
  ENST ID: ENST00000398538
  CDS Start-End: 2-4666
gatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgc

SEQ ID NO: 105389 - DNA, 5176 bp, Homo sapiens
  Payload ID: 675
  Gene Symbol: ADGRB2
  Gene Name: adhesion G protein-coupled receptor B2
  ENST ID: ENST00000398542
  CDS Start-End: 473-4873
actcggcccggcgcgcgctgcgggcagcggccggagcggccggaggaaccgggttcggcggcagcggcggcggcgctcagagaccgaagaggatgcggcaccggctctcagagcccggggctgcggccgccgcccgcaaataggaggcggcgcgcggcgcgggcggtgctcggggcgggggagcgggggagcggggggcggcgcggcaaggaggcggcggcggcggcggcggcaggagcccgcgcccggcccggcgccgcccgcccgcccgccccgcgctgctccgcggcgccttttctgcacccgccgcccgggagagcgggagcctcggccctccgcgcggctgcagctacctaccctgcgcccggcccggtccccgacttagggatggcaaacttgcgccccgtggccgcccccgccagcgccggcccccgctcctgctgctgacggcgcccagggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 105390 - DNA, 4857 bp, Homo sapiens
  Payload ID: 675
  Gene Symbol: ADGRB2
  Gene Name: adhesion G protein-coupled receptor B2
  ENST ID: ENST00000398547
  CDS Start-End: 55-4554
ccagcgccggcccccgctcctgctgctgacggcgcccagggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 105391 - DNA, 4879 bp, Homo sapiens
  Payload ID: 675
  Gene Symbol: ADGRB2
  Gene Name: adhesion G protein-coupled receptor B2
  ENST ID: ENST00000398556
  CDS Start-End: 74-4576
ggggagggagatccagcttcagacatgcaaaggaagaccccgcagaggatcctgcctgacacttagctgtcatatgctgagcctcagagggccagatactcatggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 105392 - DNA, 2541 bp, Homo sapiens
  Payload ID: 675
  Gene Symbol: ADGRB2
  Gene Name: adhesion G protein-coupled receptor B2
  ENST ID: ENST00000420125
  CDS Start-End: 1-2541
ggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccag

SEQ ID NO: 105393 - DNA, 539 bp, Homo sapiens
  Payload ID: 675
  Gene Symbol: ADGRB2
  Gene Name: adhesion G protein-coupled receptor B2
  ENST ID: ENST00000436464
  CDS Start-End: 179-183
accgcccccaggggccgagggctgccccttgtcccccttccagttctgcccgcgttttcctccttaaggaggaaccccctcccctaagagagcgaccctctctggcagtcggagcgggaggactgcacagagggggtcgctccctcccctcggcccagtccccagctccggaggcaggatggagggtgtgcgtcccccagggcgacagagctctaggagagcggctcctgaggaccctgtccttgggtccgagcgctggcagaggacccaaagccaccgagtgggggtcaccgcctgcgtggcggcctgggcaggtcgggcggcgagcgccggggaggcggagggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatgga

SEQ ID NO: 105394 - DNA, 4919 bp, Homo sapiens
  Payload ID: 675
  Gene Symbol: ADGRB2
  Gene Name: adhesion G protein-coupled receptor B2
  Uniprot ID: O60241
  ENST ID: ENST00000527361
  CDS Start-End: 39-4694
cagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcagccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttc

SEQ ID NO: 105395 - DNA, 1613 bp, Homo sapiens
  Payload ID: 675
  Gene Symbol: ADGRB2
  Gene Name: adhesion G protein-coupled receptor B2
  ENST ID: ENST00000533175
  CDS Start-End: 92-1613
atacatataacatccctgcgcacaggaacaagcaacatgcattcaggacttgggcacatgttaatacaccgtgcatgtgtgtggcacttgcatgcacctacccaggcaacatggcagtgcacacttagggcacctgtatgcatatgcaaagttcagcgcacatgactggcacctgcatgcacagggacatgcaatatgcaatgcacatgggaagggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccag

SEQ ID NO: 105396 - DNA, 2927 bp, Homo sapiens
  Payload ID: 676
  Gene Symbol: ADGRB3
  Gene Name: adhesion G protein-coupled receptor B3
  ENST ID: ENST00000238918
  CDS Start-End: 127-2313
atatgctttagcattttaaatggctacaccaaagagaaaattgaaccaggctctcttccctactcctactggactttggggtggggttattcctctgaatgttctagcggacttggggttagcttaatgcttctgccccagggcaaagaagcagttgagggaaagaaatgtcaaggacgtcagaggcgagctggactgagtgaagtgtggagtaggaagcttaggaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctac

SEQ ID NO: 105397 - DNA, 6010 bp, Homo sapiens
  Payload ID: 676
  Gene Symbol: ADGRB3
  Gene Name: adhesion G protein-coupled receptor B3
  Uniprot ID: O60242
  ENST ID: ENST00000370598
  CDS Start-End: 822-5390
ctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaagaacagtggaagagactgcagcctaaagacttttaaaattaacttggcatcacttttatcagctcaaaggctaaacaaacaaacaaaagcagtgtcatttattctaagaaataacttcttaaaggttaaagctgaaaaatattcaagttatttttggataacaacttacagaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcaatgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatca

SEQ ID NO: 105398 - DNA, 4569 bp, Homo sapiens
  Payload ID: 676
  Gene Symbol: ADGRB3
  Gene Name: adhesion G protein-coupled receptor B3
  Uniprot ID: O60242
  ENST ID: ENST00000546190
  CDS Start-End: 1-4569
atgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcaatgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccgcatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaa

SEQ ID NO: 105399 - DNA, 532 bp, Homo sapiens
  Payload ID: 676
  Gene Symbol: ADGRB3
  Gene Name: adhesion G protein-coupled receptor B3
  ENST ID: ENST00000603207
  CDS Start-End: 96-532
agtcccggtttcagcacctccggcgctggacagctctctgcacgccgcaccgccgcctgcttgctttttcccactctcgctttgcattactggagatgcatctaaattacatcctgttcaacaacaagaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactga

SEQ ID NO: 105400 - DNA, 590 bp, Homo sapiens
  Payload ID: 676
  Gene Symbol: ADGRB3
  Gene Name: adhesion G protein-coupled receptor B3
  ENST ID: ENST00000604969
  CDS Start-End: 387-590
agtcccggtttcagcacctccggcgctggacagctctctgcacgccgcaccgccgcctgcttgctttttcccactctcgctttgcattactggagatgcatctaaattacatcctgttcaacaacaagtagatttttttttcctgtacaggaattacagtagacgactctctcaattaaactgcattttcttctttacggatttggctatcaggcgtatttatcccgatttcctcccccctcactcccctttgcaggaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataag

SEQ ID NO: 105401 - DNA, 5168 bp, Homo sapiens
  Payload ID: 677
  Gene Symbol: ADGRD1
  Gene Name: adhesion G protein-coupled receptor D1
  Uniprot ID: Q6QNK2
  ENST ID: ENST00000261654
  CDS Start-End: 560-3184
actcactccccctccacccagagagcaggacggaggtgtgaacttgagccagaccagaaggagctcgagagcggccgcaggacaagcccgaggagcaggcgggcgctccaggggaaaaccacgcacaaaaccttcttcagagaaaagggaagctccaaacctgactgagacaaacggaggctcttgaaataaaaagaaaataccgcaggacaaacagcctcccgtccccgggcgcaggtcgcggtcacagtggtgacctgggattgctttcccaggactgcgagtcgggtttgggtttctcctccctgcattccacagctgctctggtcatcgcaacgtgtttattgatcactgaagaatctcaagttttgagacgaggaagaaacacccattaggtctccaagacagctgtgtttcacaaactttaaggagacagaaattttctcccctggaacctgtgaaaatgtcccttttccaaggaagtgaaggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaaggggtcacgttttcttttttctggaagacacaaggagaacagtctagaccaatcccttctgcgtatgggggacaggtcatctccaatgggttcaaagtctgctccagcggtggcagaggctctgtggagctgtatacgcgggacaattccatgacatgggaggcctccttcagccccccaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaac

SEQ ID NO: 105402 - DNA, 2892 bp, Homo sapiens
  Payload ID: 677
  Gene Symbol: ADGRD1
  Gene Name: adhesion G protein-coupled receptor D1
  ENST ID: ENST00000335486
  CDS Start-End: 216-686
gtcatggagtgtctgcacgggacgtcctggagagtcggacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggaggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaagaaa

SEQ ID NO: 105403 - DNA, 1182 bp, Homo sapiens
  Payload ID: 677
  Gene Symbol: ADGRD1
  Gene Name: adhesion G protein-coupled receptor D1
  Uniprot ID: Q6QNK2
  ENST ID: ENST00000543617
  CDS Start-End: 1-1182
atgcatcgtgtttgctttctttcatttcagacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtga

SEQ ID NO: 105404 - DNA, 735 bp, Homo sapiens
  Payload ID: 677
  Gene Symbol: ADGRD1
  Gene Name: adhesion G protein-coupled receptor D1
  ENST ID: ENST00000542091
  CDS Start-End: 74-735
aggttaagaggtcccgttctcacagaccctcaggaatttcacttggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagatattgtggaagggaaggtcaacaaaggcatttacctgaaagaggaaaagggagtcacgcttctctattacggcaggtacaacagctcctgcatcagcaagccagagcagtgtggccctgaaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataac

SEQ ID NO: 105405 - DNA, 2776 bp, Homo sapiens
  Payload ID: 677
  Gene Symbol: ADGRD1
  Gene Name: adhesion G protein-coupled receptor D1
  Uniprot ID: Q6QNK2
  ENST ID: ENST00000535015
  CDS Start-End: 31-2751
tggctccgagctttgacctccgagagagccatggaaaagctgctgcggctgtgctgctggtactcctggctgctgctattttattacaactttcaggtgcgtggcgtctactccagatcgcaggaccatccaggatttcaggtgttggcgtctgcttcccattactggccactggagaatgtggatgggatccatgaacttcaggatacaactggagcgtcccgaacccacaagctcactgtgcttccttcccgtaatgctacttttgtgtattccaatgattctgcctactcaaatctctctgcaactgtagatattgtggaagggaaggtcaacaaaggcatttacctgaaagaggaaaagggagtcacgcttctctattacggcaggtacaacagctcctgcatcagcaagccagagcagtgtggccctgaaggggtcacgttttcttttttctggaagacacaaggagaacagtctagaccaatcccttctgcgtatgggggacaggtcatctccaatgggttcaaagtctgctccagcggtggcagaggctctgtggagctgtatacgcgggacaattccatgacatgggaggcctccttcagccccccaggcccctattggactcatgtcctatttacatggaaatccaaggagggcctgaaagtctacgtcaacgggaccctgagcacctctgatccgagtggaaaagtgtctcgtgactatggagagtccaacgtcaacctcgtgatagggtctgagcaggaccaggccaagtgttatgagaacggtgctttcgatgagttcatcatctgggagcgggctctgactccggatgagatcgccatgtacttcactgctgccattggaaagcatgctttattgtcttcaacgctgccaagcctcttcatgacatccacagcaagccccgtgatgcccacagatgcctaccatcccatcataaccaacctgacagaagagagaaaaaccttccaaagtcccggagtgatactgagttacctccaaaatgtatccctcagcttacccagtaagtccctctcggagcagacagccttgaatctcaccaagaccttcttaaaagccgtgggagagatccttctactgcctggttggattgctctgtcagaggacagcgccgtggtactgagtctcatcgacactattgacaccgtcatgggccatgtatcctccaacctgcacggcagcacgccccaggtcaccgtggagggctcctctgccatggcagagttttccgtggccaaaatcctgcccaagaccgtgaattcctcccattaccgcttcccggcccacgggcagagcttcatccagatcccccacgaggccttccacaggcacgcctggagcaccgtcgtgggtctgctgtaccacagcatgcactactacctgaacaacatctggcccgcccacaccaagatcgcggaggccatgcatcaccaggactgcctgctgttcgccaccagccacctgatttccctggaggtgtccccaccacccaccctgtctcagaacctgtcgggctctccactcattacggtccacctcaagcacagattgacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccag

SEQ ID NO: 105406 - DNA, 5529 bp, Homo sapiens
  Payload ID: 677
  Gene Symbol: ADGRD1
  Gene Name: adhesion G protein-coupled receptor D1
  ENST ID: ENST00000446583
  CDS Start-End: 1856-2893
aggcgggggagccagtggctattctaggaaaattccatctccagggcatgaaaagacagataaagatcagtgtaactcacctgtgctgagtaacatggtgggtcacggtggggctctggaaccaggatgtcttgacctgagtcctgaattggccccttcccagctccgtcacttgccgtgagtcctccaaccaccatgtggcttcgtggcttcatttgtaaagtggggcaagagtgtgcgcagctggcaagggctgagcaattgaatgacttcactcatgtaaaacagagcaggaccaggcgcagggcaggtccgtggaaaaggttaactattgccatcattaggaaccatcaaggggctcacacacatgatctcagtggaggcttctagcagcctgtgagggggtgttagagatgtctggatgccagcaacagacgctgactctggttctcctgagcagaaaggtagtttattggaaggataaggggagcacaatgtatcagagtgaagtcatgaaaacaagacaaaatccaaggtcttagaaaatatcttatatggtattattatatcatttttgtattcggcacaaaaagggcaggccaaaaataagccctaatgagacaactgtataaaaacgttttgagtagcctaatgagtgaaaattatttaaaacgtgttaattattattgcatgtatgaaagaatacaggtcgccttgttgcgatagaaatgccaaagtcccttgctttccaataacatgggcctgagaaaattcagtgtcactcatccacgacgatccgatgtggaggttcctattcccacggagatgaagccacaagcaaaggcctgtccgtgtgcaggtctgtcctgagcatgaacatcctgtcccagagagaaaatgctccctctgggaagagcctccctgggcaccccttgggtccttggagcccttctgggccacatctctgcttagcgttgggggacctgtcacacccgagtggggtgaccacgggctcgcgacctgtatgaggcgagactccagcattctaggggatgaccgcaaaaccaggccctcagcagaggccgcctccttccagagccttctgtggctgggcgggggtctccaggcagctccgcagcccccgcaaataccccctggtgctgagtccgcttatacagacagagacgaagggcagcgacagcgtttttgttttctgaagtgggagggtctcgtgaccgcagctcaggaggaaaacgaggcgccggctttgcaggtgggtaggagtttgtgttgtactcggaggctgggagcccctggggcttctgtagggagaggcggtctgagacgcgctttagaagttgacctgctgctctgcggggactcggtgcgggagacgagtggaggctgctgcgtcatccaggtgagaggagagccaggtgcgcagtgagcagaggtgggaggaaagctggttgccacggagatgagggcgtgtccatcactgcaaggctccacccacagcactatcctgggcggaaccttcctggccccacccacagccttagctgattggactgtggagtacatgtgacttcaggctgtgtccttataggttggctggcctctagtgccctgcccatgtggtcatggagtgtctgcacgggacgtcctggagagtcggacacgtaagcagcacagtgaggccaccaacagcagcaaccgagtcttcgtgtactgcgccttcctggacttcagctccggagaaggggtctggtcgaaccacggctgtgcgctcacgagaggaaacctcacctactccgtctgccgctgcactcacctcaccaactttgccatcctcatgcaggtggtcccgctggagcttgcacgcggacaccaggtggcgctgtcgtctatcagctatgtgggctgctccctctccgtgctctgcctggtggccacgctggtcaccttcgccgtgctgtcctccgtgagcaccatccggaaccagcgctaccacatccacgccaacctgtccttcgccgtgctggtggcccaggtcctgctgctcattagtttccgcctcgagccgggcacgaccccctgccaagtgatggccgtgctcctacactacttcttcctgagtgccttcgcatggatgctggtggaggggctgcacctctacagcatggtgatcaaggtctttgggtcggaggacagcaagcaccgttactactatgggatgggatggggttttcctcttctgatctgcatcatttcactgtcatttgccatggacagttacggaacaagcaacaattgctggctgtcgttggcgagtggcgccatctgggcctttgtagcccctgccctgtttgtcatcgtggtcaacattggcatcctcatcgctgtgaccagagtcatctcacagatcagcgccgacaactacaagatccatggagaccccagtgccttcaagttgacagccaaggcagtggccgtgctgctgcccatcctgggtacctcgtgggtctttggcgtgcttgctgtcaacggttgtgctgtggttttccagtacatgtttgccacgctcaactccctgcagggactgttcatattcctctttcattgtctcctgaattcagaggccaggtgggccaaggagggcagagcagagtcgctgagcaggatggtggccgggcagaagggctgcatgatcacaaagcccagtgaccccttgatcgcaacgcccagtgaccccttgcaaggcctgaggtggatcccggtggcaggaaggcagtgcagccatggaagcccgcccgcccacccgcctgcctgcccaccacgcatttgtttatttgcttctctctcacactcaccccgggacattcattgctgagtgtgaggagcccagcagaggccactccacacccagcttccctggcctgcgatacaacctggctctgccccacagagcagcgatgcacagctcagctgtggagccagcagctccgactcatatttccaaatcccaacctccctcgcacatctggttccggagttgcaccggcacagactcctctggttacggctgttgcagcctctgaaattgctctcacgatcccttccccgctttcaaggtgagagccgccttcaagcacaaaaccaaggtctggtcgctcacgagcagctctgcccgcacctccaacgcgaagcccttccactcggacctcatgaatgggacccggccaggcatggcctccaccaagctcagcccttgggacaagagcagccactctgcccaccgcgtcgacctgtcagccgtgtgagccgggaggctgccaaccaggccaggctgcgctcagaacacacccccccaaacagaatgaaatgccccacctttgcccatggaccctctccttgctgctgtctggacatgggtgttgtggccccgagacagctgtcctcccctgtgactctggctgtcggagcacactgctcagcccagcagcctgatgcccaggccagcgtgggccctcctgccttgcatccacccgtgggctgagtgacttcctcgggggattcccaggacacagtggcctgactgtgatggtgcccttgagcctcccttcatcactcagcatcagacccagcgaggccaggacactcggggccggtcccgcagcaccaggaggggatgttcagcctctgtgccttggtggggcttggggactcagggccaaagaggtggttcaggtccccacgcaccctcagtcaggcgcaggcagctgggggtgtgtggggaagagcatgcggagtccccagtgtctgaatccactgagtggtgagttccccacagccggcgctagccgtggtgtgtgtctctgtaggtggtgccggcgtgggccaacctgtgctgtgtcatcagttgggggcccctgcccaagccgagctcgagccgtgggcgggagtcgttgactctccaggtgagggcgacccctctgccctgtccttgggggggtcccctctgctcacgtgaagagccgctctgggccttgaggctgcctgatggtgcctgtgcttgggggagcttctcggccatccgctgtgagttttgcctctttggaccccaattcggccttaagatgccctcctccctcgtgtgccagcctccttggttgttcttgggccacaggagctggccgtgtccccgcagtgcctggtgtccaggtggaaagtggagggcattttccagggcactgctttccccagaggcttcctcatggctcacaggcactctacgaagtttctaatgggcagaccacgcggcaggtagcacagtgcgctccgtctggtcaccatgagaccgacctgcgctgagtccccactgacctggagagggagggctggtgacagccgtgtcttctgtgttgagggaaatttatggactcagattcagccccagaggagatgggataattgttatggacccatgtgtgggcatgatcctgtggaacacaggtttgggatcatagatgtgaattaagacaccaccgagatacgggctgtgaggttcatactgtgctgatagcactcgtggtgtctgtgaaatgtgggtaagacattcaaacctggttttgatactggaaactcttcctttaaaactgtgaccatgatttcattcagcccctccacacccctatgtctgccttgtttcagagtgagttttctatggagcctgtggcccttttgcagcccacctggtggcttcttaatgtaactcttcccctggtcgcctggagtggaccactcatctgcaggcctctcctgcatggggagggtaggcagggagcagcatgtctgcaggggtgaacctttgctcttctgtcaggcgaggcccaggctgcaccagccacctgccacatggtgacagtgccacgggccctgcgtatggcccctgcaaccgtgctctggcgggcacacctggctgctgcaggccaaggccgctgttcagtgaagagtcccatgtttagtatggactaaagtcccatgtttagccactgccccaggctcccgtgaccccagaaaccaggtcacatggaccacagtgccagatcctcatcacgccggtgagcacctagaagtgagaacactgtattcctacaatgtacacttggatatttctccttatttagtttctagtgaaacaaatcaagtaaggaactatctttagtttagatggaattatttgtttttaattgttgccgtattcatctatatagctaatatttcaagataagtaatgaacaaaacctgtctaaaccttttgtttccaatgaatgaaagtcatgcactttatttataggctctatgttttggcttctgcagtacttttattatctatacataatttggccaaaaataagaaattggaaagaatgaaatgtttagtttatagtagaagaaagatgatgacactaagttgtgaaaatatgttgtgatttttatgaaataaactcatgtcctgaaaagaaa

SEQ ID NO: 105407 - DNA, 3244 bp, Homo sapiens
  Payload ID: 678
  Gene Symbol: ADGRD2
  Gene Name: adhesion G protein-coupled receptor D2
  Uniprot ID: Q7Z7M1
  ENST ID: ENST00000334810
  CDS Start-End: 1-2917
atcaggagtctctctgggaccccctccaactccccaggtgaatcaaggaacccttgggccccaggttgcccccgtggccgccggcgaggtggtgaagactgcaggtggggtgtgcaagttctctggacagcgactgagctggtggcaggcccaagagtcctgcgagcagcagtttggccacttggcactgcagccccctgatggggttcttgcttcacggctgcgcgatccggtctgggtgggccaaagagaggcccctctgcggagacccccacagaggcgtgcgcgcaccaccgccgtgctggtgttcgacgagaggacggctgaccgggcggcgcggctgcggagccctctgcctgagctggcagcgctgaccgcgtgtactcacgtgcagtgggactgtgcctcgcccgaccccgcagcgctcttctccgttgccgcgcccgcgctgcccaacgcgctgcagctgcgcgccttcgccgagccggggggcgtcgtgcgcgctgcgctggtggtgcgtgggcagcacgcgcccttcctcgcagccttccgcgccgacggccgctggcaccatgtgtgcgccacgtgggagcagcggggcgggcgctgggcgctgttctccgatgggaggcggcgcgctggggcgcgggggctgggcgccggccacccggtgccgtccggcggcatcctggtgctgggccaggatcaggactctctgggcggtggcttctcggtgcgtcacgccctcagcggcaacctcaccgacttccacctgtgggcgcgggcgctgagccccgctcagctgcaccgggcacgggcctgcgcgccgccctcagagggcctgctcttccgctgggacccgggcgccctggacgtcacgccctcgctgctgcccactgtgtgggtgcgccttctctgtcccgtgccctccgaggagtgccctacgtggaacccgggacctcgcagtgagggctctgagctctgcctggagccgcagcccttcctctgctgctaccggacagagccctatcgtcggctgcaggatgcccagtcgtggcctggccaggatgttatcagccgagtcaatgccttggccaacgacattgtgctcctcccggaccccctctccgaagtccatggggccctgtccccagcggaggcctccagcttcctgggccttctggagcatgtcctggcgatggagatggctcccctggggccggccgcactgctggctgttgtccgcttcctgaagagggtggtggccctcggggctggggacccagagctgttgttgacaggcccctgggagcagctgagccaaggcgttgtatctgtggccagcctggtcctggaggagcaggtggctgacacatggctctccctccgtgaagtgattggtgggcctatggccctggtggcgagtgtgcagcgcctggcacccctgctgagcacctcaatgacctcagagcggccccgaatgcgcatccagcaccgccatgctggcctggaggtgcggagcttacgcttgagggaggccagcacgaggggctgcttattcacaatgcctggtgggcgtccagaggggcccggccatatccacattcctgcgagtgaagtgaggcgactcctcaggaaaggcctctctggagtcaccgtgatccacagctggttcacctccagagtcttccagcacaccctagagggaccggacctagagccccaggcccctgccagctcagaggaggcaaacagggtgcagaggttcctaagcacccaggtggggtcagccatcatctcctctgaagtgtgggacgtcactggagaggtcaacgtggccatgacctttcatctccagcaccgggcccagagccccctgttccctccccatcccccaagcccatatacagggggtgcctgggccaccacaggctgctccgtggctgccctgtacctggactccaccgcctgcttctgcaaccacagcaccagctttgccatcctgctgcaaatctatgaagtacagagaggccctgaggaggagtcgctgctgaggactctgtcatttgtgggctgtggcgtgtccttctgcgccctcaccaccaccttcttgctcttcctggtggccggggtccccaagtcagagcgaaccacagtccacaagaacctcaccttctccctggcctctgccgagggcttcctcatgaccagcgagtgggccaaggccaatgaggtggcatgtgtggctgtcacagtcgcaatgcacttcctctttctggtggcattctcctggatgctggtggaggggctgctgctgtggaggaaggtggtagctgtgagcatgcacccgggcccaggcatgcggctctaccacgccacaggctggggcgtgcctgtgggcatcgtggcggtcaccctggccatgctcccccatgactacgtggcccccggacattgctggctcaatgtgcacacaaatgccatctgggccttcgtggggcctgtgctcttcgtgctgactgccaacacctgcatcctggcccgtgtggtaatgatcaccgtgtccagtgcccgccgccgtgcccgcatgttgagcccacagccctgcctgcagcagcagatctggacccagatatgggccacggtgaagcccgtgctggtcctgctgcccgtcctaggcctgacctggctggcaggcatcctggtgcacctgagccccgcctgggcctacgctgccgtgggcctcaactccatccaggggctgtacatcttcctggtttatgctgcctgcaatgaggaggtgcggagcgccctgcagaggatggctgagaagaaggtggccgagggacctatggccctagaactccctcagcattctcctccattgcaaacccggagagacaggctgtggaactgacagcgttcaaagcttcaggtttctagagagtggctgggaaactcgtcgccaaaccctgcccagctcagctctgctgggaccccagaccccagaacggcgcagcgggagtccctgagccccaacagcggccccagctcccgtggcctcagcctctggctttccctaaaggactgtgggcctcagccccctgttcccctagcccaccaggtccccaggctctttcccccagtctttgcctatctgtgatctgctccttcccccatgctccgaagttccaacgggctctgccgtgtctggtaataaataggactgttgggctctcctgtc

SEQ ID NO: 105408 - DNA, 722 bp, Homo sapiens
  Payload ID: 678
  Gene Symbol: ADGRD2
  Gene Name: adhesion G protein-coupled receptor D2
  ENST ID: ENST00000610875
  CDS Start-End: 1-126
tttctggtggcattctcctggatgctggtggaggggctgctgctgtggaggaaggtggtagctgtgagcatgcacccgggcccaggcatgcggctctaccacgccacaggctgggggccacggtgaagcccgtgctggtcctgctgcccgtcctaggcctgacctggctggcaggcatcctggtgcacctgagccccgcctgggcctacgctgccgtgggcctcaactccatccaggggctgtacatcttcctggtttatgctgcctgcaatgaggaggtgcggagcgccctgcagaggatggctgagaagaaggtggccgagggacctatggccctagaactccctcagcattctcctccattgcaaacccggagagacaggctgtggaactgacagcgttcaaagcttcaggtttctagagagtggctgggaaactcgtcgccaaaccctgcccagctcagctctgctgggaccccagaccccagaacggcgcagcgggagtccctgagccccaacagcggccccagctcccgtggcctcagcctctggctttccctaaaggactgtgggcctcagccccctgttcccctagcccaccaggtccccaggctctttcccccagtctttgcctatctgtgatctgctccttcccccatgctccgaagttccaacgggctctgccgtgtctggtaataaataggactgttgggctctcctgtc

SEQ ID NO: 105409 - DNA, 2939 bp, Homo sapiens
  Payload ID: 679
  Gene Symbol: ADGRE1
  Gene Name: adhesion G protein-coupled receptor E1
  Uniprot ID: Q14246
  ENST ID: ENST00000250572
  CDS Start-End: 44-2509
agtagaaaagtttcttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactgatttaccctaggataaaga

SEQ ID NO: 105410 - DNA, 3128 bp, Homo sapiens
  Payload ID: 679
  Gene Symbol: ADGRE1
  Gene Name: adhesion G protein-coupled receptor E1
  Uniprot ID: Q14246
  ENST ID: ENST00000312053
  CDS Start-End: 38-2698
aaagtttcttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactgatttaccctaggataaaga

SEQ ID NO: 105411 - DNA, 3056 bp, Homo sapiens
  Payload ID: 679
  Gene Symbol: ADGRE1
  Gene Name: adhesion G protein-coupled receptor E1
  Uniprot ID: Q14246
  ENST ID: ENST00000381404
  CDS Start-End: 31-2634
cttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtggtaagcaaatactacaacagcctggcgaagtgtgttctgaaggaggagcaaggagacctgcgagatctggaatttccagggacgtgtgcagctgagaggatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactgatttaccctag

SEQ ID NO: 105412 - DNA, 2687 bp, Homo sapiens
  Payload ID: 679
  Gene Symbol: ADGRE1
  Gene Name: adhesion G protein-coupled receptor E1
  Uniprot ID: Q14246
  ENST ID: ENST00000381407
  CDS Start-End: 39-2276
aaaagtttcttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactg

SEQ ID NO: 105413 - DNA, 2567 bp, Homo sapiens
  Payload ID: 679
  Gene Symbol: ADGRE1
  Gene Name: adhesion G protein-coupled receptor E1
  Uniprot ID: Q14246
  ENST ID: ENST00000450315
  CDS Start-End: 33-2162
ttcttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtc

SEQ ID NO: 105414 - DNA, 956 bp, Homo sapiens
  Payload ID: 679
  Gene Symbol: ADGRE1
  Gene Name: adhesion G protein-coupled receptor E1
  ENST ID: ENST00000595026
  CDS Start-End: 1-956
tgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagaggggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggc

SEQ ID NO: 105415 - DNA, 6767 bp, Homo sapiens
  Payload ID: 680
  Gene Symbol: ADGRE2
  Gene Name: adhesion G protein-coupled receptor E2
  Uniprot ID: Q9UHX3
  ENST ID: ENST00000315576
  CDS Start-End: 453-2924
ggtctgctctgtgcggtgaagcttctcttcttggcacctgcctggcatcggaagagggccccttctccctccctgggcttttatgtggacactgtaatgcctcagttttctttctttctttttgtttttgacacagggtctcactctatcacccaagctggagtgcagtggcaccatcttagctcaccgcagcctcaaactccccagctcgggtgattcttcctgcctcagcctcctgagtagtagcagctgggaccacagacgtctgccaccaagcccagctgcaccgccagttccggggagggccctgggccagcggctgtccgccccccctcctttataaagtcctggcctcgggacagcccgcacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcattcaattcctgcagaaaccggaaatcttccatgccctgcaatgtgctcatcaaactctcagcatatggacggccagctgtggcccatatcttggtcactctgaagcacaatatttatgaagctatagaacgttaagacctctttcacagcctctccttcctacaaagactcctccaaatcttaaaatgaagcaggaaaacgagcctaagaggactttcataccgacaacatctgaaaggactagaatgttcacaccacgatctggatttcttaattttttgtttttgtttttgttgttctctagttctacgggtttgattatttagtcatgtgaaaaatattgattactcacacatagatcaagagagacacggctcctgccttcatggagcttttaggggaaaatgaagtggctcttgcagctagagttgactcagaagccgaaattcctagaaatcaggtttctactgctaggcaattgaagtataaactattttataaacactgtcttctttcgtcttcacaccaacatgcagaaaagtttctaatctcagatcggggatgtgcaacaaattccatttcaaaggaatgacctgcaaaactcctaaatattccaagcaaatgcccttaaccctgtctgttatctgctttccttgaacagaaattctacatgaccataaaacctcgaagatgggtatggcacagttcatgccctgtaatcctagcactttgggagggtgaggcaggaggatggctcaagcccaggagtttgagaccagtgtgggcaacagagtgagaaccatctctacccaaaaaaaaaattaaaaattagccaagcatggtgatgatataggagttaaggagaaatcatttaggcaaatagcaagggtaggaagtcctcagtaaggttttccatttaatgaaaagcagcccccaaaatcattttcttttctaacaaagaacagcctgtaaaatcgagctgcagacatagacaagcaagctggaagcttccacgggtgaatgccggcagctgtgccaataggaaaaagctacctagactaggcatgtccaaaatggcggctccaagttcccttctctttgccagccatgtgtacagtaaaaagcaggcaacatagtgtcagccaaagctcatttgcataataagattagggtggggtggccagctcacataggggtaggccctaggtaaatcagacaccgccttctcaagcctgtctataaaatctggtacactatgacgagggtcagatttcccattcagacgcccctctcccatgcaagagaaagagctgttctcctttctctttcttttgcctattaaacctctgctcctggccaggcacagtggctcacgcctataatcccagcactttgggaggctgaggtggtcagatcacctaaggtcaggagttcaagaccagcctggtcaacatggtgaaatcttgtctctagtaaaaatacaaaaatatatgaaatctcacatagatgataatattaagttccaaaagcaactcaacctggtagattctaattttttttgaggcagggtcttgctttgtcacccatgctggagtacaatggcacaaacactgctcactgcagcctcgacctcccaaggcctaagcaatcctcctgcctcagtccccctccaggtatttgaaactacaggtgtgtaccaccacaccgggctaatttttgtattttttgtagagacgtgggtctcactatgctgcccaggctcaggtcttaatctcctgagctcaggcaatccgcaggcctcagcctccctaagtgcggggattacaggcttgagccactgcacctagcctctatttgttttacaaaagagaaattgagatcctgaatgttaagtgacttgcctgaggccatcccactaacaggagccagggttaggattcaaaccccatccaactggtcccagagctggagcttcttgcactgccctacactacctaccatctccatcctctgggcacctttttataagaaccaaaacattacagagcattgctttgtcaactcagctgggaacatttcccagtgcaactcacatttttcactgctctgtgcctgtccgtataagctcaatgagtattgatttaggggctttggagaactttgaatgctaccccccaagtaaccattgttggcaacctggtacctctacttttagccatttctccttctctataaatagtgcagaagtaacccacttggtaacaggcatccttgccaagcctccaccactaggtcagtgtaagaattaaagaaagaggaaagaaacacaaaaagtggcttgatggttaagacaggtttattttagagaaaacacacctgagaggggctgctggctgaattaggttagagtcttttctacagactaagagtgtttaaggatttagggtgggagagtttcttagaggcttggactgcttctgtgttttttttgttgtgcttatatgggagggagagtggtgtgtttgcttttatacatttttctgcagctgtaggcataccccccaagtctgcttttagcttccctattttagtgcacctggagggaaaggaatgtgcttattaaggcccactgttttactggggcccattgtatgagggtgaagtttggcagttacccaagagacttttcctccaccttcctctgtgcccgagctgttttatctgcattttactgtctgctttttttggctgcttatagtttttaaaaaagtaatttccttaaatccagaaggctaaaaatgaagctgaaacttaaagtggcggtgtttgtccaaaataacggggctcctgctctgccagtcagtaccctcaagtcactcctgatcctcaacctccatgcctaaggctggttcaagagaccacataatatctgccttttattacatacatgatgggtgcatgggattctgcgtgccctttgcttgatatagactgctaaggtgagatggggaatatcagagtcagctgctgcttgaggaagcagaacacacagctggaggcttggaacatgtgggtccctatgagtgtagagcccatatccccatagagtctacctagagcaggggtcgccaaatgttttcttaaagagcctgatagtgtatatgttaggctttgtgagccaggtatttacagcaactcaattctaccactgtggtatgaaaacagctatagacaatcataaatgaatgatcatggctatgttttaataaaactttacagacactgaacttgaacttccattgtgatatgaaaacagctatagacaatcataaatgaatgatcatggctatgttttaataaaactttatggacactgagcttgaacttcatatatcagtcatgtgacacaaaatatcattcttctttttatttgttttcacccatttgaaaaatgtaaaaactattcttagctgtacagaaacagatggtgggtcagatttgactcactgcccatagtttccagaccatgatgttcaggttcatggaagcacttcactctacactaatttattcatccattcatcacatatgtgatgagcacatacagacacacctcagagatattgcaggctccactccagatcaccacaataatgtgaatattgcaataaagcaagtcatacacatt

SEQ ID NO: 105416 - DNA, 1497 bp, Homo sapiens
  Payload ID: 680
  Gene Symbol: ADGRE2
  Gene Name: adhesion G protein-coupled receptor E2
  ENST ID: ENST00000392962
  CDS Start-End: 86-1225
acagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacg

SEQ ID NO: 105417 - DNA, 2513 bp, Homo sapiens
  Payload ID: 680
  Gene Symbol: ADGRE2
  Gene Name: adhesion G protein-coupled receptor E2
  Uniprot ID: Q9UHX3
  ENST ID: ENST00000392965
  CDS Start-End: 87-2384
cacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgtgaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaa

SEQ ID NO: 105418 - DNA, 2046 bp, Homo sapiens
  Payload ID: 680
  Gene Symbol: ADGRE2
  Gene Name: adhesion G protein-coupled receptor E2
  Uniprot ID: Q9UHX3
  ENST ID: ENST00000595839
  CDS Start-End: 1-2046
atgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactag

SEQ ID NO: 105419 - DNA, 1511 bp, Homo sapiens
  Payload ID: 680
  Gene Symbol: ADGRE2
  Gene Name: adhesion G protein-coupled receptor E2
  ENST ID: ENST00000595208
  CDS Start-End: 1-992
cattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagtcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgac

SEQ ID NO: 105420 - DNA, 2325 bp, Homo sapiens
  Payload ID: 680
  Gene Symbol: ADGRE2
  Gene Name: adhesion G protein-coupled receptor E2
  Uniprot ID: Q9UHX3
  ENST ID: ENST00000594294
  CDS Start-End: 1-2325
atgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactag

SEQ ID NO: 105421 - DNA, 3128 bp, Homo sapiens
  Payload ID: 680
  Gene Symbol: ADGRE2
  Gene Name: adhesion G protein-coupled receptor E2
  ENST ID: ENST00000601345
  CDS Start-End: 87-2582
cacagctgcccagcctgcggagacgggacagccctgtcccactcactctttcccctgctgctcctgccggcagctcagctggaaccatgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacgccaggaacagtggttcaagcttgtaatgccagcactctgggaggccaaagcaggaagatcacttgagcccgggacaacttggggatcacttgaagccatattatcctatgcctcaatggcatgggataattcatgacattgatgactaataaccaacatttattaatgtagacatacaaagttctgttgtatttttctcacctcttcttccatcttctccagattatatgtgtaattctaaccccatttcactgatgagcaaagtaagactacttggatttgtgtcaaatgtacagagtctcggccaggcacagtgactcatgcctgtaatcccagcactttgggaggccgaggcaggtggatcacaaagtcaggagatcgagaccatcctggctaacacggtgaaaccccatctctactaaaaatacaaaaaaaaaaaaaaaatagccaggcgtggtggtgggcgactgtagtcccagctactcgggaggctgtggcaggagaatggtgtgaacccaggaggcagagctggcagtgagccgagatcgcgccaatgcactccagcctgggcaacagaacgagactctgtctcaaaaaaaaaaaaaaaaaaaa

SEQ ID NO: 105422 - DNA, 2596 bp, Homo sapiens
  Payload ID: 680
  Gene Symbol: ADGRE2
  Gene Name: adhesion G protein-coupled receptor E2
  Uniprot ID: Q9UHX3
  ENST ID: ENST00000596991
  CDS Start-End: 1-2439
atgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgaatgtcagcagaacccaaggctctgtaaaagctacggcacctgcgtcaacaccctcggcagctacacgtgccagtgcctgcctggcttcaagctcaaacctgaggacccgaagctctgcacagatgtgaatgaatgcacctccggacaaaacccatgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactagaaaaatcttctgaataagatcttccctctttgcccgtggaaaatctgaacaatctttgagccatctagaggggaaagaaaagactttgttctgtgtgtttcaagaaattcaccatgtcagcaatatgaaggatgttatggaaggcgtgctaggcatt

SEQ ID NO: 105423 - DNA, 2193 bp, Homo sapiens
  Payload ID: 680
  Gene Symbol: ADGRE2
  Gene Name: adhesion G protein-coupled receptor E2
  Uniprot ID: Q9UHX3
  ENST ID: ENST00000594076
  CDS Start-End: 1-2193
atgggaggccgcgtctttctcgtctttctcgcattctgtgtctggctgactctgccgggagctgaaacccaggactccaggggctgtgcccggtggtgccctcaggactcctcgtgtgtcaatgccaccgcctgtcgctgcaatccagggttcagctctttttctgagatcatcaccacccccatggagacttgtgacgacatcaacgagtgtgcaacactgtcgaaagtgtcatgcggaaaattctcggactgctggaacacagaggggagctacgactgcgtgtgcagcccaggatatgagcctgtttctggggcaaaaacattcaagaatgagagcgagaacacgtgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactacaagccaggcttggccaataacaccatccagagcatcttacaggcgctggatgagctgctggaggcccctggggacctggagaccctgccccgcttacagcagcactgtgtggccagtcacctgctggatggcctagaggatgtcctcagaggcctgagcaagaacctttccaatgggctgttgaacttcagttatcctgcaggcacagaattgtccctggaggtgcagaagcaagtagacaggagtgtcaccttgagacagaatcaggcagtgatgcagctcgactggaatcaggcacagaaatctggtgacccaggcccttctgtggtgggccttgtctccattccagggatgggcaagttgctggctgaggcccctctggtcctggaacctgagaagcagatgcttctgcatgagacacaccagggcttgctgcaggacggctcccccatcctgctctcagatgtgatctctgcctttctgagcaacaacgacacccaaaacctcagctccccagttaccttcaccttctcccaccgttcagtgatcccgagacagaaggtgctctgtgtcttctgggagcatggccagaatggatgtggtcactgggccaccacaggctgcagcacaataggcaccagagacaccagcaccatctgccgttgcacccacctgagcagctttgccgtcctcatggcccactacgatgtgcaggaggaggatcccgtgctgactgtcatcacctacatggggctgagcgtctctctgctgtgcctcctcctggcggccctcacttttctcctgtgtaaagccatccagaacaccagcacctcactgcatctgcagctctcgctctgcctcttcctggcccacctcctcttcctcgtggcaattgatcaaaccggacacaaggtgctgtgctccatcatcgccggtaccttgcactatctctacctggccaccttgacctggatgctgctggaggccctgtacctcttcctcactgcacggaacctgacggtggtcaactactcaagcatcaacagattcatgaagaagctcatgttccctgtgggctacggagtcccagctgtgacagtggccatttctgcagcctccaggcctcacctttatggaacaccttcccgctgctggctccaaccagaaaagggatttatatggggcttccttggacctgtctgcgccatcttctctgtgaatttagttctctttctggtgactctctggattttgaaaaacagactctcctccctcaatagtgaagtgtccaccctccggaacacaaggatgctggcatttaaagcgacagctcagctgttcatcctgggctgcacgtggtgtctgggcatcttgcaggtgggtccggctgcccgggtcatggcctacctcttcaccatcatcaacagcctgcagggtgtcttcatcttcctggtgtactgcctcctcagccagcaggtccgggagcaatatgggaaatggtccaaagggatcaggaaattgaaaactgagtctgagatgcacacactctccagcagtgctaaggctgacacctccaaacccagcacggttaactag

SEQ ID NO: 105424 - DNA, 2254 bp, Homo sapiens
  Payload ID: 681
  Gene Symbol: ADGRE3
  Gene Name: adhesion G protein-coupled receptor E3
  Uniprot ID: Q9BY15
  ENST ID: ENST00000253673
  CDS Start-End: 102-2060
ttcaattctcatgggatttcttgagctaggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgacattaatgaatgtacaccaccctatagtgtatattgtggatttaacgctgtgtgttacaatgtcgaaggaagtttctactgtcaatgtgtcccaggatatagactgcattctgggaatgaacaattcagtaattccaatgagaacacctgtcaggacaccacctcctcaaagacaaccgagggcaggaaagagctgcaaaagattgtggacaaatttgagtcacttctcaccaatcagactttatggagaacagaagggagacaagaaatctcatccacagctaccactattctccgggatgtggaatcgaaagttctagaaactgccttgaaagatccagaacaaaaagtcctgaaaatccaaaacgatagtgtagctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccggaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttca

SEQ ID NO: 105425 - DNA, 2267 bp, Homo sapiens
  Payload ID: 681
  Gene Symbol: ADGRE3
  Gene Name: adhesion G protein-coupled receptor E3
  Uniprot ID: Q9BY15
  ENST ID: ENST00000344373
  CDS Start-End: 149-1951
gcttttctgatagcaatttcatgagtcagctgacctaagatacatacttcaattctcatgggatttcttgagctaggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgacaccacctcctcaaagacaaccgagggcaggaaagagctgcaaaagattgtggacaaatttgagtcacttctcaccaatcagactttatggagaacagaagggagacaagaaatctcatccacagctaccactattctccgggatgtggaatcgaaagttctagaaactgccttgaaagatccagaacaaaaagtcctgaaaatccaaaacgatagtgtagctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccggaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttcactatggtgtattcagtcaatgcttgtccctggaaacccaaagcatgaccactgcaaatatttccttgactttttgtaaatgaagaggtccttttcctcaagttcttagtcccactcatccta

SEQ ID NO: 105426 - DNA, 1971 bp, Homo sapiens
  Payload ID: 681
  Gene Symbol: ADGRE3
  Gene Name: adhesion G protein-coupled receptor E3
  ENST ID: ENST00000443157
  CDS Start-End: 75-1655
aggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccggaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttcactatggtgtattcagtcaatgcttgtccctggaaacccaaagcatgaccactgcaaatatttccttgactttttgtaaatgaagaggtccttttcctcaagttcttagtcccactcatccta

SEQ ID NO: 105427 - DNA, 486 bp, Homo sapiens
  Payload ID: 681
  Gene Symbol: ADGRE3
  Gene Name: adhesion G protein-coupled receptor E3
  ENST ID: ENST00000595472
  CDS Start-End: 229-402
caatagctaggcagaaaaggtacagcaaataaacgaaaagcagaaccatgagtctgatggcgaaagaggggaagcagtttgcttttctgatagcaatttcatgagtcagctgacctaagatacatacttcaattctcatgggatttcttgagctaggaaaggtggttggcttacggcacagtagagagcttccagggctggctggcgtgggatacccgtaccacagaaatgcagggaccattgcttcttccaggcctctgctttctgctgagcctctttggagctgtgactcagaaaaccaaaagtgagtgctcagagccagaacagagaacttgtggaccaagggctggacctggagccactcatggtctccagtgggctggagaaaagtgcctgttctgagagcaatatttgggaaggcttgctcctgtgtttcattatttgtttgcttaatttatcattatatcaaatatggatagcctttta

SEQ ID NO: 105428 - DNA, 2099 bp, Homo sapiens
  Payload ID: 681
  Gene Symbol: ADGRE3
  Gene Name: adhesion G protein-coupled receptor E3
  ENST ID: ENST00000599900
  CDS Start-End: 589-1902
aacggaagtggctgtggctcaggctgttgtggccagggtagccttaggcggcggcagagaaactaacgtcttctttagcctccaaggagaaattctagtattcttacccgggggatgaggcctctgctttctgctgagcctctttggagctgtgactcagaaaaccaaaacttcctgtgctaagtgccccccaaatgcttcctgtgtcaataacactcactgcacctgcaaccatggatatacttctggatctgggcagaaactattcacattccccttggagacatgtaacgacattaatgaatgtacaccaccctatagtgtatattgtggatttaacgctgtgtgttacaatgtcgaaggaagtttctactgtcaatgtgtcccaggatatagactgcattctgggaatgaacaattcagtaattccaatgagaacacctgtcaggacaccacctcctcaaagacaaccgagggcaggaaagaggtgagtggaggctgatccccagacccttcccagctattgaaactcaagcgattacagacaattgctctgaagaaagaaagacattcaacttgaacgtccaaatgaactcaatggacatccgttgcagtgacatcatccagggagacacacaaggtcccagtgccattgcctttatctcatattcttctcttggaaacatcataaatgcaactttttttgaagagatggataagaaagatcaagtgtatctgaactctcaggttgtgagtgctgctattggacccaaaaggaacgtgtctctctccaagtctgtgacgctgactttccagcacgtgaagatgacccccagtaccaaaaaggtcttctgtgtctactggaagagcacagggcagggcagccagtggtccagggatggctgcttcctgatacacgtgaacaagagtcacaccatgtgtaattgcagtcacctgtccagcttcgctgtcctgatggccctgaccagccaggaggaggatcccgtgctgactgtcatcacctacgtggggctgagcgtctctctgctgtgcctcctcctggcggccctcacttttctcctgtgtaaagccatccggaacaccagcacctcactgcatctgcagctctcgctctgcctcttcctggcccacctcctcttcctcgtggggattgatcgaactgaacccaaggtgctgtgctccatcatcgccggtgctttgcactatctctacctggccgccttcacctggatgctgctggagggtgtgcacctcttcctcactgcacggaacctgacagtggtcaactactcaagcatcaatagactcatgaagtggatcatgttcccagtcggctatggcgttcccgctgtgactgtggccatttctgcagcctcctggcctcacctttatggaactgctgatcgatgctggctccacctggaccagggattcatgtggagtttccttggcccagtctgtgccattttctctgcgaatttagtattgtttatcttggtcttttggattttgaaaagaaaactttcctccctcaatagtgaagtgtcaaccatccagaacacaaggatgctggctttcaaagcaacagctcagctcttcatcctgggctgcacatggtgtctgggcttgctacaggtgggtccagctgcccaggtcatggcctacctcttcaccatcatcaacagcctccaaggcttcttcatcttcttggtctactgcctcctcagccagcaggtccagaaacaatatcaaaagtggtttagagagatcgtaaaatcaaaatctgagtctgagacatacacactttccagcaagatgggtcctgactcaaaacccagtgagggggatgtttttccaggacaagtgaagagaaaatattaaaactagaatattcaactccatatggaaaatcatatccatggatctctttggcattatgaagaatgaagctaaggaaaagggaattcattaaacatatcatccttggagaggaagtaatcaacctttacttcccaagctgtttgttctccacaataggctctcaacaaatgtgtggtaaattgcatttctcttcacta

SEQ ID NO: 105429 - DNA, 3188 bp, Homo sapiens
  Payload ID: 682
  Gene Symbol: ADGRE5
  Gene Name: adhesion G protein-coupled receptor E5
  Uniprot ID: P48960
  ENST ID: ENST00000242786
  CDS Start-End: 81-2588
acagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacag

SEQ ID NO: 105430 - DNA, 3054 bp, Homo sapiens
  Payload ID: 682
  Gene Symbol: ADGRE5
  Gene Name: adhesion G protein-coupled receptor E5
  Uniprot ID: P48960
  ENST ID: ENST00000357355
  CDS Start-End: 90-2450
acagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaga

SEQ ID NO: 105431 - DNA, 2751 bp, Homo sapiens
  Payload ID: 682
  Gene Symbol: ADGRE5
  Gene Name: adhesion G protein-coupled receptor E5
  Uniprot ID: P48960
  ENST ID: ENST00000358600
  CDS Start-End: 369-2597
agagcagccagccccaacacagaggccaaagggttcgtcagagccacatggtggaaactctagcagagggtttttgaaagcaggttgcacttcattcttactgagtgcacgtgtgtgtgtgtgtgtgtgtgtgtgtgtgtgtgtgtgtgtatgcagcgcccctgggtctgtgtttttattgcactttcctgctggcttccagctgcaccgccagttccggggagggccctgggccagcggctgtccgccccccctccttcataaagtcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctgg

SEQ ID NO: 105432 - DNA, 572 bp, Homo sapiens
  Payload ID: 682
  Gene Symbol: ADGRE5
  Gene Name: adhesion G protein-coupled receptor E5
  ENST ID: ENST00000587606
  CDS Start-End: 109-572
ataaagtcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaaggtaagaaccaccccacgtcctctgactttccatccatgaggtttggggtcaccagagccattctggcagcatccagagagcagggccttggttgtagggtcagtgcctggcgtctgag

SEQ ID NO: 105433 - DNA, 578 bp, Homo sapiens
  Payload ID: 682
  Gene Symbol: ADGRE5
  Gene Name: adhesion G protein-coupled receptor E5
  ENST ID: ENST00000586517
  CDS Start-End: 109-578
ataaagtcctggcctcgggacagcctgcacagctgcctagcctgtggagacgggacagccctgtcccactcactctttcccctgccgctcctgccggcagctccaaccatgggaggccgcgtctttctcggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgcc

SEQ ID NO: 105434 - DNA, 573 bp, Homo sapiens
  Payload ID: 682
  Gene Symbol: ADGRE5
  Gene Name: adhesion G protein-coupled receptor E5
  ENST ID: ENST00000592261
  CDS Start-End: 81-573
acagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaag

SEQ ID NO: 105435 - DNA, 2142 bp, Homo sapiens
  Payload ID: 683
  Gene Symbol: ADGRF1
  Gene Name: adhesion G protein-coupled receptor F1
  ENST ID: ENST00000283297
  CDS Start-End: 1-2142
atggacatatcaatacaaagaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataa

SEQ ID NO: 105436 - DNA, 1370 bp, Homo sapiens
  Payload ID: 683
  Gene Symbol: ADGRF1
  Gene Name: adhesion G protein-coupled receptor F1
  Uniprot ID: Q5T601
  ENST ID: ENST00000371243
  CDS Start-End: 148-804
agatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaatgtcactcttgtcgcccaagttggagtgcaatggcacaatctaggctcactgcaaccctgcaacctctgcctaccgggttcaagagattcccctgcctcagcctcccaagtagctggaattacagacacctgccaccacatccagctaactttttttgtatttttagtagagacagggtttcaccatgttggccacactggtctcaaactcctgacctcaggtgatccgcctgcctcggcccccaaagtgctgggattacaggcatgagccaccacatctggcctaggaccttaaatattggaaagcattctcaaaactgtgggtcagtgagtagaactacaaaacaatagcagtagggcagaaacttgaaagaaggcaggagatcatggtgacagtggatgggaaaaagtgagggttggggataagggttgcgggttgtcgaagggtggattttctccttcagcaactacaggagatatgatgcctcataattcggagccagaagtggggctttgggtgagatatctttgcacagataacatgtatacatcatagttcaaaacccagtagtcattgtttacagcaaataaagaaatatttagtaaatta

SEQ ID NO: 105437 - DNA, 5468 bp, Homo sapiens
  Payload ID: 683
  Gene Symbol: ADGRF1
  Gene Name: adhesion G protein-coupled receptor F1
  Uniprot ID: Q5T601
  ENST ID: ENST00000371253
  CDS Start-End: 217-2949
agtaatgcgtgccaggaattgctgatggatcagtgagcctgtgttcatgccagtgagctgctgtggctcagatactgatactttctttccaaacagcataagaagtgattgagccacaagtatactgaaggaagggctccctcgagttctggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggattttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcattactgctcccttttgtcttcaattaaatgaaaagaagatttatttccatgtgatttgattcaaagaaagtgctccataaatgcagaagagtaggttttgttggaaatcgtgtcagttgtaccctgaccataaaatatggtttctattttcataaaacagcattattcacatggcatttccaataatctggattgaaggaagaaaattttatgaaatagctttagataaattaataggccacgttcattttcttgtcaaaaagttactggtggggggatggtgggaaaaagttattagtgcaaatttcctagagaaaaaaccatttctctttcaaattttccagttgaattttatgttcgcttttgcttcttaggttctatcacttaatattgaaagttaatcagaaataaaatgtaaacttctatttcagatagctttgtaaccatttatcagaaagtataataatgtgatatgatatataatgtggtatttttcagtttacaaggcacttccatctggtcctaaaccctgcaaacaaaagtgtcaaggcagacctagtgcagagatgagggcatgggggctcagagaggtaaagtgacttgccaaagattgtgaagccagttaagggaaattggggatttttaggacatttgtctcccagaccatttctacagccaataaaagccttgaaaattacctacatctctagtaaatctttctgaggtcagttacacagttcaccattcccagaattctatgtaagagagaaattaagggagaatttggttgtcagcttccagggaggtaccttaaaacatccttattttctttcataatacaccataggcactttgtggaagttattttcttgtacagccagtgccacttttggatgacatacaaagcagcaggagttgacgctatgtgaagcaacacttctcttccatacttccatcacatttggctcacctacctgagtttcagccgtgaccatagtgcccagaggaacccgagcctttgattcatccttgctgttttgagaggcctagggagtgtctcttagcctcctgacatggaaagccttcatgctatgcaaataaagacagctgggggaacttctagttagtggtggtagattaaataagcatacctgagagaaattcaaagttagacttccacaaggcaccaaggtgcagcacacatgaaatatgaaagtgagaggttcaaaggaaatgactgaggatcagttagatggttctataccccacaaatatgtatgagagtcaacagaattttatgagaaagacttctttgcagaaaactgctctatgagccttctcactctacctacccacaaaagtgagagaaggaggaatgtctgctccttgacctcaaatttagtgagagaagatttctcagatagctcagatagctcagatttctcagaaccacaacaattaggatgcatggctgatggaagtctgattcttgcctagaattgtggccacagctccggtagtagagccctgaatgagttctgtgttgagaatagcctgtatgtctagtgtttgtcagggcaatggatgtgtgtgtttcccatgaaccatagtgagacatgcaagagtgaaggtcagcatggggctcttttaggtcctctctgatagggttgtccaaagaggtggagggaacccagcatcaagaagtgggaggtgaagccagattgtgggatgaggaaggagtcacaaatgaccacctggaatacaaaaaaatctacacaagctaaagatgagaagtcagggctatgagaatttctatgggagttcttgaatgctccctctcttattacacacaattactatccagagaaccctgacaccatgtgaaggcagccctatctcataagacagatttctttttttggggaccttggggaaagggaggccagaaacctccgtgtccaaggtggggtggaaggagagggagaaatcttagcaaaaatgtcaaccagcaagggaagatgtgctagcgcaagtaggcaactcaacacaagactcagttggagagggaagaaaaatttagtactaaattattgtagtttcttcttattgtaggcgactgggagtcataattaccaaactatttaaaatgaccaaaatgttgctcttacctgagtatgttggcatacaactggaatgtatctgatggaagaaaaagcttctcccactgaataaattttatgaggatgatgagagacaaaaaaatgtttgatcagatatcatgtatgtgcatgcttgtctaattcactgattatgcatacattcacctcaaaatgctactaaaacaacaataaaataatgaaaaagtgaatagca

SEQ ID NO: 105438 - DNA, 722 bp, Homo sapiens
  Payload ID: 683
  Gene Symbol: ADGRF1
  Gene Name: adhesion G protein-coupled receptor F1
  ENST ID: ENST00000475745
  CDS Start-End: 1-483
gaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacc

SEQ ID NO: 105439 - DNA, 561 bp, Homo sapiens
  Payload ID: 683
  Gene Symbol: ADGRF1
  Gene Name: adhesion G protein-coupled receptor F1
  ENST ID: ENST00000487323
  CDS Start-End: 1-412
atggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcggacagttatacacctgtggaacctggtttaacttcactaaatcaaacctataacaagcaggaaaatactctgtaatcaatagaatggacatatcaatacaaagaaatggaagcatcgttgctgggtatgaagttgttggctccagcagtgcatctgaactgctgtcagccattgaacatg

SEQ ID NO: 105440 - DNA, 2127 bp, Homo sapiens
  Payload ID: 684
  Gene Symbol: ADGRF2
  Gene Name: adhesion G protein-coupled receptor F2
  Uniprot ID: Q8IZF7
  ENST ID: ENST00000296862
  CDS Start-End: 1-2127
atggggctgactgcctatgggaaccgcagggtccagcctggggagctgccattcggggctaacttgactctcatccatacaagagcccagcctgtgatttgtagcaagcttctcttgacaaagagagtgagtcccatctctttcttcttgtccaaatttcaaaattcctggggtgaggatggatgggttcagttggatcaactgccatcccctaatgcagtcagctctgaccaagtacactgttcagctggctgcacacacaggaaatgtggatgggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccaggtaagtccagatgcttctgaccaagtgcaaagtgagagaattcatgaagatgttctgtga

SEQ ID NO: 105441 - DNA, 4895 bp, Homo sapiens
  Payload ID: 684
  Gene Symbol: ADGRF2
  Gene Name: adhesion G protein-coupled receptor F2
  Uniprot ID: Q8IZF7
  ENST ID: ENST00000398742
  CDS Start-End: 50-1978
ctttttatttctttttatagaaacaagaaagtcagctgtgtggaagacaatgactcatatacttttgctgtactacttggtgtttcttttgcccacagagtcctgtaggacattgtatcaggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccagggtttcttcatcctagtgtttggaaccatcctggatccaaagataagagaagccttaaagggttgagtagcctctgcaaaaaggagctccagaatatcagagaatgcttcttctgaattatcttgtcatcccatcaaaggcccaagttaacaaaccaggctacatccctaacctaggaggaatggcagagcccaaaggagaaatgtgctcattcctgtcttcttgcttctggagaatatgtaggaagctcacacatgtggtgctgatggaggagggcgtgatgtgcagaaaggatgaaaggctcctctgtctaagctgttctgtgctactaaacatttctcgtccatcaactgtacatagctacatatgtcatgctgggcagccacagcaaacaaaaagacaaagggggccacaaccgtggtttttgttggggcttccatctctatgctgttgggtcacatttgtcttcagaaagcaacctctgtctcatcttggaaaaggcggcctgagatttcacctggctggattctgtgtgttgctgagggaggagcctcatgaatagtcacaaagagttgggctgactctaagtaggacattgcagattatttttttttttcaaaaggaatccactgccagtatatccactttttcaaatttaaatagattggattgtcaacttggtttaggcttagatacaacttccttggccatgaaccaaggggaaaagcatagagcttttgagacagaaagatgaccattttcagttaaggagatggaagtctggagttgtgagtcaatgctaatcgaggactgagccagaggtagaaacccaagtgtgctggctcccagccctgtacttcctcttcaagaccatatagacactgaaagatcttctgcctacactgacaatgtaaggtcaatcctcaccaacaatatgcttttttgatacctgggattggagagaggaaatatcacatttccaattcagagctgctctttttcttaacctgtatgtaaacaaattcaacattcaaaccaggtgttacctgatagaacagtattgtaggtagaagctctttgaggaaaaaaaaaaaacctctttacaaagcaaggacatagatgactgcagcagcatctaactagtggatgaaggcaaaggggcaatgggcagcctttaattatcccaacaagaagtcagtattgatgacgtttcattacaaaggagaaagtggggctcaccttaggtatgagtgcagtcccttccttccttccttccttccttccttccttccttccttccttccttccttccttccttccttccttccttccttcttccctccctccctccctctctctctctctttctccctttctctttctttctttttttctccctctctctctttctttctttctttgtttcttattacaaataatcttcctataagtaggaaagtttgagcagacaaaaagcatcaatctgaagttaaaaaaaatgcatcaacctggagaaatagtcatttttcaaatggcattgcttatcttgggacaacaaaagcatccttcacaaataaagtcagagagtggttttaatttaccatttaccaatagatttgtatgttcttttcaagagaaggggtgagatagacatagtcctggttttcctcaatgcaggcttaggtacaaagagatgtcacttacccagagtccatatattgaagtgaaaatggaatttcatgaagcaaatatagttataggatggtaactctggacaaattttataaaagatgaactccaattgcttcatttcacagataacagctctgagcactagggagagagggagggattggcctagcatttgctttgtgtcttgagcagtcacatctattatggaagtactcactactcagctatactcactccctgagacaggatggttggaaagaaaccccaccttagcttcatcattaaccaagaaaccccaaggatgcttagagaaaaactctggaattatttgggaattcctggaagaagctatgccctctctcctgcatcccaaagcccactctacaccatcttgaaaaatgtcaaggaactgcatggattaggttgactctggatgaccctgggtagagacacattcagtttcctgctgacaccgcaccaagaaagtgatttggtcaggtgactctaggagaaattggtactgatagtatccaaggcagatttttaagtatcagacttaatacataatgattcttgggaaagccatttaaatccctgagactttaagtggataaatgtaggtaaagtagtatagtacttggctcataataattgctcattcaaattcacatgttagttttagttgttttttttaaattagagtcctgtgaatacatgaacccacccacccacatgcaaacacaagcaaacacacagccatgaccccatgcataagtttggctgaagacaccctcatgggaactagttcactgacttccaaattaaagagttaagcatttgatttggtctgttcaacattaggggtatcagccagcaaaatctgttgagcttaccattgaaaaatcctttcattcattactgtggtcataatacacagttacctggccaggaaagagtacacatcacagggatctgctcactgcacgtgtgcctgagctctccctcactttctgccttcttcaagaattcttccctgattggtccaaccagaagcgctgattctccccacctgatttcctgtaattttataatctatgtccttcacttttgtgttatattgtttatttccttttggtctttttgtgtgcatatgtatatgttttggggaatggggtattcacttttgttactcactgtgttactcacttttgtatgcccatagtgcagagcatggtgccttgtacatagagtatgttcggtaaatatgtgcaataaaaagtcctttgattac

SEQ ID NO: 105442 - DNA, 3043 bp, Homo sapiens
  Payload ID: 684
  Gene Symbol: ADGRF2
  Gene Name: adhesion G protein-coupled receptor F2
  ENST ID: ENST00000507065
  CDS Start-End: 279-2201
aggagctactcccatgcaggacttgtctgtcaggctgcagcactcctgcacatggggctgactgcctatgggaaccgcagggtccagcctggggagctgccattcggggctaacttgactctcatccatacaagagcccagcctgtgatttgtagcaaggtatgacagaagagagccagtaatgcccatatctccagctgccagggagtggggcaaatttgccggtgagtttgtctttggccagccacaaaacaagaaagtcagctgtgtggaagacaatgactcatatacttttgctgtactacttggtgtttcttttgcccacagagtcctgtaggacattgtatcaggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccaggtaagtccagatgcttctgaccaagtgcaaagtgagagaattcatgaagatgttctgtgattaggtgcttgtgacattagatttctacataaaagccaatggatttggaatagcatatggagtggggaaataaacttttgttccagagatacctggatttggatcctgactctttcatttactaataatgtataacatgatcttgggatatttactcaacttttttcaagccatattttcctcacatataaaatgagtgcaatactgttcactttataggggtgtttggaaagtgaaattaaatggtgaatgggaaaggatcaagtactaaaatgatctaaagaccatagacagcctagtaataggctaagttgttatggtttaaaaattaagcaataacaccttccccaaaatttaggtatgtagctggaggtattaaagtttgcacatttattacatttccttccacttaggatttttaactaccattggaaaccatcttattttaacatggcaagctctacagagaggtattgaagatagtttctcctctcttctcttatcacacttagatgaattaagcaacgttcacagtttcatgtgtatgctttgccaaattttctatgcttatacaaacatattttcacataacacgggttaaaacaatgtatattattgtgtaacttgcttttgcacttaaaaatatgctctagaattttaccagctcattatgcatgaatatttctctaatggctgcataccattccatattcaataatttccttcttgattgaaatttttctccattgttttgtgttatagtatgtgaatgatccaaagtttattatattgaatgttaatatgtagatagtaactaattgaaaagaaagcttttatttttc

SEQ ID NO: 105443 - DNA, 5126 bp, Homo sapiens
  Payload ID: 684
  Gene Symbol: ADGRF2
  Gene Name: adhesion G protein-coupled receptor F2
  Uniprot ID: Q8IZF7
  ENST ID: ENST00000467205
  CDS Start-End: 277-2205
gcaaggtatgacagaagagagccagtaatgcccatatctccagctgccagggagtggggcaaatttgccgtagagacggggtttcaccgtgttagccaggatggtctcgatctcctgacctcgtgatctgcgcacctcggcctcccaaagtgctgggattacagatatgaaccatcgcgcccggcccagaagatgacttcttgactcctctctctccgtatctgacactacttcattctttaccaggaaacaagaaagtcagctgtgtggaagacaatgactcatatacttttgctgtactacttggtgtttcttttgcccacagagtcctgtaggacattgtatcaggctgcaagcaaaagcaaggagaaggtgcctgccaggccacacggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccagggtttcttcatcctagtgtttggaaccatcctggatccaaagataagagaagccttaaagggttgagtagcctctgcaaaaaggagctccagaatatcagagaatgcttcttctgaattatcttgtcatcccatcaaaggcccaagttaacaaaccaggctacatccctaacctaggaggaatggcagagcccaaaggagaaatgtgctcattcctgtcttcttgcttctggagaatatgtaggaagctcacacatgtggtgctgatggaggagggcgtgatgtgcagaaaggatgaaaggctcctctgtctaagctgttctgtgctactaaacatttctcgtccatcaactgtacatagctacatatgtcatgctgggcagccacagcaaacaaaaagacaaagggggccacaaccgtggtttttgttggggcttccatctctatgctgttgggtcacatttgtcttcagaaagcaacctctgtctcatcttggaaaaggcggcctgagatttcacctggctggattctgtgtgttgctgagggaggagcctcatgaatagtcacaaagagttgggctgactctaagtaggacattgcagattatttttttttttcaaaaggaatccactgccagtatatccactttttcaaatttaaatagattggattgtcaacttggtttaggcttagatacaacttccttggccatgaaccaaggggaaaagcatagagcttttgagacagaaagatgaccattttcagttaaggagatggaagtctggagttgtgagtcaatgctaatcgaggactgagccagaggtagaaacccaagtgtgctggctcccagccctgtacttcctcttcaagaccatatagacactgaaagatcttctgcctacactgacaatgtaaggtcaatcctcaccaacaatatgcttttttgatacctgggattggagagaggaaatatcacatttccaattcagagctgctctttttcttaacctgtatgtaaacaaattcaacattcaaaccaggtgttacctgatagaacagtattgtaggtagaagctctttgaggaaaaaaaaaaaacctctttacaaagcaaggacatagatgactgcagcagcatctaactagtggatgaaggcaaaggggcaatgggcagcctttaattatcccaacaagaagtcagtattgatgacgtttcattacaaaggagaaagtggggctcaccttaggtatgagtgcagtcccttccttccttccttccttccttccttccttccttccttccttccttccttccttccttccttccttccttccttcttccctccctccctccctctctctctctctttctccctttctctttctttctttttttctccctctctctctttctttctttctttgtttcttattacaaataatcttcctataagtaggaaagtttgagcagacaaaaagcatcaatctgaagttaaaaaaaatgcatcaacctggagaaatagtcatttttcaaatggcattgcttatcttgggacaacaaaagcatccttcacaaataaagtcagagagtggttttaatttaccatttaccaatagatttgtatgttcttttcaagagaaggggtgagatagacatagtcctggttttcctcaatgcaggcttaggtacaaagagatgtcacttacccagagtccatatattgaagtgaaaatggaatttcatgaagcaaatatagttataggatggtaactctggacaaattttataaaagatgaactccaattgcttcatttcacagataacagctctgagcactagggagagagggagggattggcctagcatttgctttgtgtcttgagcagtcacatctattatggaagtactcactactcagctatactcactccctgagacaggatggttggaaagaaaccccaccttagcttcatcattaaccaagaaaccccaaggatgcttagagaaaaactctggaattatttgggaattcctggaagaagctatgccctctctcctgcatcccaaagcccactctacaccatcttgaaaaatgtcaaggaactgcatggattaggttgactctggatgaccctgggtagagacacattcagtttcctgctgacaccgcaccaagaaagtgatttggtcaggtgactctaggagaaattggtactgatagtatccaaggcagatttttaagtatcagacttaatacataatgattcttgggaaagccatttaaatccctgagactttaagtggataaatgtaggtaaagtagtatagtacttggctcataataattgctcattcaaattcacatgttagttttagttgttttttttaaattagagtcctgtgaatacatgaacccacccacccacatgcaaacacaagcaaacacacagccatgaccccatgcataagtttggctgaagacaccctcatgggaactagttcactgacttccaaattaaagagttaagcatttgatttggtctgttcaacattaggggtatcagccagcaaaatctgttgagcttaccattgaaaaatcctttcattcattactgtggtcataatacacagttacctggccaggaaagagtacacatcacagggatctgctcactgcacgtgtgcctgagctctccctcactttctgccttcttcaagaattcttccctgattggtccaaccagaagcgctgattctccccacctgatttcctgtaattttataatctatgtccttcacttttgtgttatattgtttatttccttttggtctttttgtgtgcatatgtatatgttttggggaatggggtattcacttttgttactcactgtgttactcacttttgtatgcccatagtgcagagcatggtgccttgtacatagagtatgttcggtaaatatgtgcaataaaaagtcctttgattacacaa

SEQ ID NO: 105444 - DNA, 3240 bp, Homo sapiens
  Payload ID: 685
  Gene Symbol: ADGRF3
  Gene Name: adhesion G protein-coupled receptor F3
  Uniprot ID: Q8IZF5
  ENST ID: ENST00000311519
  CDS Start-End: 1-3240
atggtctgttcggctgccccactgctgctcctggccacaactcttcccctgctggggtcaccagttgcccaagcatcccaacctgtaagtgagactggggtgagacccagggaaggtctgcagaggcgacaatggggacccctgattgggagagacaaagcatggaatgaaaggatagacagacccttccctgcctgccccatccccctatcttctagctttggccgatggcccaagggccagacaatgtgggcccagacctccaccctcaccctgacagaggaggagttgggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgggtcccctgtcacctgcctccctgcagtccccgggatcctcaacctgaactcccagctgcagatgcctggtgacacgctgagcctgactctccatctgagccaggaggccaccaacctgagctggttcctgaggcacccagggagccccagtcccatcctcctgcagccagggacacaggtgtctgtgacttccagccacggccaggctgccctcagcgtctccaacatgtcccatcactgggcaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggtgagttgctgccttcagatcctcagctgtgcatccaagagcatgtcagaaggcattccatggccctcctcagaggacatgggcacagccagaagctga

SEQ ID NO: 105445 - DNA, 3896 bp, Homo sapiens
  Payload ID: 685
  Gene Symbol: ADGRF3
  Gene Name: adhesion G protein-coupled receptor F3
  Uniprot ID: Q8IZF5
  ENST ID: ENST00000333478
  CDS Start-End: 584-3205
ctccctttcatctggtggccctagcgccacaagctgccgcttaggaagtccctgccgggagcagaagtggagacatcagcaggatggcatcggcaagtcgctcccctcccgggcctcatctgccaaacgatcatctcctcctccgaagttgtatgcatgacaggcgagtggaaacttcactaaaatgaaggcgattgacacaacagaaggaactccatcctttcgggggcttacgaaaataataagtttaaaaaaaataggaagggaattccctcgctccatgatcactgagcgctctcctaaggaaaaggaaatctcccggggggtgccgactacgggcggcgggcttaggatgctcccacgctccccgacccccaatccccaggacccgcaggacctccggaggaacgcccgccagcccgcccggagccacgcggcacaaggtgacacggaccgcgccgcgcgggcccctcagccgcctgggcgaggccgggagcagggagaggggcatccgccggcccgcggtaccttgtacttatcaaagccagccagctgctccgggctcacgtattcgtagccagccatgacgacccgaaaactgagcgcccactcggcagcgactcccggctacaaggctgtgacacacaagcaccacaccggctgggcaaggatggcaaagactgggctgcccgagaagggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggaagacagatgcttcagagtgaaccacacacggacccatgttcctgcaagggagttgaggctgtgtgcttgaacccaccagatgagccctggcccaatgctctgaactcttcccgcctcccggagctcagcccttgagaaaggcaggcttatatttcccttagtgacactcatttatcttacagctcaccccttctcatttctaaagtatccagcaagaatagcaggaaaaattagctaaaggcacctaatgaataagcctgcctttgctccagaaataatcgacagatatcaaagtgcggaataattacaagtaaactttctcaaccagtttttaactacaacaatacatgttgtgaatgaatatatttgataaaaatggttttaattgacctattcagcgatttctgattatttctttttcaatagttatgaagaaaggatgacttacttgacaggaacctctgatctttcaaacattggagatgaagggcagaatttggtttgtcttttcaagtttaggaaaaggtgaagttaattggtccctctttctttaacctttaaaaaatcaatataaaatgtaagtttcttaaccatatccatgtatagaggcattgattgatatgagcacgttgtaagaataggttataaaaatttaaagtttaatataaatttatatcaattaataaagtttaatttatatttaaaaatgaa

SEQ ID NO: 105446 - DNA, 3353 bp, Homo sapiens
  Payload ID: 685
  Gene Symbol: ADGRF3
  Gene Name: adhesion G protein-coupled receptor F3
  Uniprot ID: Q8IZF5
  ENST ID: ENST00000421160
  CDS Start-End: 54-3047
tcttccttgcggaaatttgcatcgtgggcttgtagggactgcttcactgagccatggtctgttcggctgccccactgctgctcctggccacaactcttcccctgctggggtcaccagttgcccaagcatcccaacctggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgggtcccctgtcacctgcctccctgcagtccccgggatcctcaacctgaactcccagctgcagatgcctggtgacacgctgagcctgactctccatctgagccaggaggccaccaacctgagctggttcctgaggcacccagggagccccagtcccatcctcctgcagccagggacacaggtgtctgtgacttccagccacggccaggctgccctcagcgtctccaacatgtcccatcactgggcaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggtgagaactaggctttctcaggggcagcgtaagcagggtggattgaggacggtgtggcaaagggcctcctggcaaagtgctggagagaagcctcctctttctatacccagcccacaccaaagggtaggaaacaggtttttctagggtagccattgctagatggctgggagacggtggaaatgtcagagagcagaaagcatagcaccttatcttgctttccaagaaagcaagaagtttcaccaccaccagtccttgacttggtttctctgaaaattccttttcacattatcacacatttaattatcatgag

SEQ ID NO: 105447 - DNA, 3620 bp, Homo sapiens
  Payload ID: 685
  Gene Symbol: ADGRF3
  Gene Name: adhesion G protein-coupled receptor F3
  ENST ID: ENST00000435303
  CDS Start-End: 510-872
atcagcaggatggcatcggcaagtcgctcccctcccgggcctcatctgccaaacgatcatctcctcctccgaagttgtatgcatgacaggcgagtggaaacttcactaaaatgaaggcgattgacacaacagaaggaactccatcctttcgggggcttacgaaaataataagtttaaaaaaaataggaagggaattccctcgctccatgatcactgagcgctctcctaaggaaaaggaaatctcccggggggtgccgactacgggcggcgggcttaggatgctcccacgctccccgacccccaatccccaggacccgcaggacctccggaggaacgcccgccagcccgcccggagccacgcggcacaaggtgacacggaccgcgccgcgcgggcccctcagccgcctgggcgaggccgggagcagggagaggggcatccgccggcccgcggtaccttgtacttatcaaagccagccagctgctccgggctcacgtattcgtagccagccatgacgacccgaaaactgagcgcccactcggcagcgactcccggctacaaggctgtgacacacaagcaccacaccggctgggcaaggatggcaaagactgggctgcccgagaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggaagacagatgcttcagagtgaaccacacacggacccatgttcctgcaagggagttgaggctgtgtgcttgaacccaccagatgagccctggcccaatgctctgaactcttcccgcctcccggagctcagcccttgagaaaggcaggcttatatttcccttagtgacactcatttatcttacagctcaccccttctcatttctaaagtatccagcaagaatagcaggaaaaattagctaaaggcacctaatgaataagcctgcctttgctccagaaataatcgacagatatcaaagtgcggaataattacaagtaaactttctcaaccagtttttaactacaacaatacatgttgtgaatgaatatatttgataaaaatggttttaattgacctattcagcgatttctgattatttctttttcaatagttatgaagaaaggatgacttacttgacaggaacctctgatctttcaaacattggagatgaagggcagaatttggtttgtcttttcaagtttaggaaaaggtgaagttaattggtccctctttctttaacctttaaaaaatcaatataaaatgtaagtttcttaaccatatccatgtatagaggcattgattgatatgagcacgttgtaagaataggttataaaaatttaaagtttaatataaatttatatcaattaataaagtttaatttatatttaaaaatgaatactagaagaaaatctttttgaagacaccaagatatctatctggctgaattaacttatggaattcacaagaggaagatgacaggattctgagaaatttttaaactagatacgtgaaaaaagtctgatgaatcggtctttgttaattatgcaattcatggatattttttataaaatgggacgggggcattttctgttaaaataaaaatggttatgctatc

SEQ ID NO: 105448 - DNA, 3493 bp, Homo sapiens
  Payload ID: 685
  Gene Symbol: ADGRF3
  Gene Name: adhesion G protein-coupled receptor F3
  Uniprot ID: Q8IZF5
  ENST ID: ENST00000447444
  CDS Start-End: 584-3205
ctccctttcatctggtggccctagcgccacaagctgccgcttaggaagtccctgccgggagcagaagtggagacatcagcaggatggcatcggcaagtcgctcccctcccgggcctcatctgccaaacgatcatctcctcctccgaagttgtatgcatgacaggcgagtggaaacttcactaaaatgaaggcgattgacacaacagaaggaactccatcctttcgggggcttacgaaaataataagtttaaaaaaaataggaagggaattccctcgctccatgatcactgagcgctctcctaaggaaaaggaaatctcccggggggtgccgactacgggcggcgggcttaggatgctcccacgctccccgacccccaatccccaggacccgcaggacctccggaggaacgcccgccagcccgcccggagccacgcggcacaaggtgacacggaccgcgccgcgcgggcccctcagccgcctgggcgaggccgggagcagggagaggggcatccgccggcccgcggtaccttgtacttatcaaagccagccagctgctccgggctcacgtattcgtagccagccatgacgacccgaaaactgagcgcccactcggcagcgactcccggctacaaggctgtgacacacaagcaccacaccggctgggcaaggatggcaaagactgggctgcccgagaagggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggccacaaatgaaggctgcatcttggaacacagcaaaggaggaagcgacactgccaggaagacagatgcttcagagtgaaccacacacggacccatgttcctgcaagggagttgaggctgtgtgcttgaacccaccagatgagccctggcccaatgctctgaactcttcccgcctcccggagctcagcccttgagaaagttatgaagaaaggatgacttacttgacaggaacctctgatctttcaaacattggagatgaagggcagaatttggtttgtcttttcaagtttaggaaaaggtgaagttaattggtccctctttctttaacctttaaaaaatcaatataaaatgtaagtttcttaaccat

SEQ ID NO: 105449 - DNA, 575 bp, Homo sapiens
  Payload ID: 685
  Gene Symbol: ADGRF3
  Gene Name: adhesion G protein-coupled receptor F3
  ENST ID: ENST00000433584
  CDS Start-End: 313-575
ccctgccgggagcagaagtggagacatcagcaggatggcatcggcaagtcgctcccctcccgggcctcatctgccaaacgatcatctcctcctccgaagttgtatgcatgacaggacccgcaggacctccggaggaacgcccgccagcccgcccggagccacgcggcacaaggtgacacggaccgcgccgcgcgggcccctcagccgcctgggcgaggccgggagcagggagaggggcatccgccggcccgcggtaccttgtacttatcaaagccagccagctgctccgggctcacgtattcgtagccagccatgacgacccgaaaactgagcgcccactcggcagcgactcccggctacaaggctgtgacacacaagcaccacaccggctgggcaaggatggcaaagactgggctgcccgagaagggacagagtcaggctggaggggaatctggatctgggcagctcctggaccaagagaatggagcaggggaatcagcgctggtctccgtctatgtacatctggactttccagataagacctggccccctgaactctccaggacactgactct

SEQ ID NO: 105450 - DNA, 3162 bp, Homo sapiens
  Payload ID: 686
  Gene Symbol: ADGRF4
  Gene Name: adhesion G protein-coupled receptor F4
  Uniprot ID: Q8IZF3
  ENST ID: ENST00000283303
  CDS Start-End: 259-2346
acaagccttgaaactgtgggtaactttacagttctcagatcggcttctcgcaacaggcagtcagttctcactgggccccttggactcccatttcaaaaatggagaagacagatcacagccactgaccagggaccgtgggaggtgccacgtgatggtgaggcatcatgctagggagctgagctctgaccttcctgctgggtgattctccacctctgggctgctagatctacttcctggatgccgtgaagatcctcatgtatgaaaatgaagtcccaggcaaccatgatttgctgcttagtgttctttctgtccacagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttg

SEQ ID NO: 105451 - DNA, 3074 bp, Homo sapiens
  Payload ID: 686
  Gene Symbol: ADGRF4
  Gene Name: adhesion G protein-coupled receptor F4
  Uniprot ID: Q8IZF3
  ENST ID: ENST00000327753
  CDS Start-End: 171-2258
acaagccttgaaactgtgggtaactttacagttctcagatcggcttctcgcaacaggcagtcagttctcactgggccccttggactcccatttcaaaaatggagaagacagatcacagccactgaccagggaccgtgggaggtgccacgtgatggtgaagatcctcatgtatgaaaatgaagtcccaggcaaccatgatttgctgcttagtgttctttctgtccacagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttg

SEQ ID NO: 105452 - DNA, 3075 bp, Homo sapiens
  Payload ID: 686
  Gene Symbol: ADGRF4
  Gene Name: adhesion G protein-coupled receptor F4
  ENST ID: ENST00000371220
  CDS Start-End: 1-2259
atgtacactggtccctgtaaggtcctccacctctcatctgggcttttaccaaatagcggtaggtttggtattgttctcagcgatgaataccaggttgtaacatctttatggtgccagctgtatacaacccatgcacctcaacaggcctctggaatgcttcttctgaattatcttgtcatcccatcaaaggcccaagttaacaaaccaggctacatccctaacctaggagaatgttcccactatagatccaagattcacctaaaagctggagataaacttcaaagccctgaagggaaacccaagactggaaggatccaagagaaatgcgaaggaccttgtatttcttcttccaactgcagccagccctgtgctaaggactttcatggagaaataggatttacatgtaatcaaaaaaagtggcaaaaatcagctgaaacatgtacaagcctttctgtggaaaaactctttaaggactcaactggtgcatctcgcctttctgtagcagcaccatctatacctctgcatattctagactttcgagctccagagaccattgagagtgtagctcaaggaatccgtaagaactgcccctttgattatgcctgcatcactgacatggtgaaatcatcagaaacaacatctggaaatattgcatttatagtggagttattaaaaaatatttctacagacttgtctgataatgttactcgagagaaaatgaagagctatagtgaagtggccaaccacatcctcgacacagcagccatttcaaactgggctttcattcccaacaaaaatgccagctcggatttgttgcagtcagtgaatttgtttgccagacaactccacatccacaataattctgagaacattgtgaatgaactcttcattcagacaaaagggtttcacatcaaccataatacctcagagaaaagcctcaatttctccatgagcatgaacaataccacagaagatatcttaggaatggtacagattcccaggcaagagctaaggaagctgtggccaaatgcatcccaagccattagcatagctttcccaaccttgggggctatcctgagagaagcccacttgcaaaatgtgagtcttcccagacaggtaaatggtctggtgctatcagtggttttaccagaaaggttgcaagaaatcatactcaccttcgaaaagatcaataaaacccgcaatgccagagcccagtgtgttggctggcactccaagaaaaggagatgggatgagaaagcgtgccaaatgatgttggatatcaggaacgaagtgaaatgccgctgtaactacaccagtgtggtgatgtctttttccattctcatgtcctccaaatcgatgaccgacaaagttctggactacatcacctgcattgggctcagcgtctcaatcctaagcttggttctttgcctgatcattgaagccacagtgtggtcccgggtggttgtgacggagatatcatacatgcgtcacgtgtgcatcgtgaatatagcagtgtcccttctgactgccaatgtgtggtttatcataggctctcactttaacattaaggcccaggactacaacatgtgtgttgcagtgacatttttcagccactttttctacctctctctgtttttctggatgctcttcaaagcattgctcatcatttatggaatattggtcattttccgtaggatgatgaagtcccgaatgatggtcattggctttgccattggctatgggtgcccattgatcattgctgtcactacagttgctatcacagagccagagaaaggctacatgagacctgaggcctgttggcttaactgggacaataccaaagcccttttagcatttgccatcccggcgttcgtcattgtggctgtaaatctgattgtggttttggttgttgctgtcaacactcagaggccctctattggcagttccaagtctcaggatgtggtcataattatgaggatcagcaaaaatgttgccatcctcactccactgctgggactgacctggggttttggaatagccactctcatagaaggcacttccttgacgttccatataatttttgccttgctcaatgctttccagggttttttcatcctgctgtttggaaccattatggatcacaagataagagatgctttgaggatgaggatgtcttcactgaaggggaaatcgagggcagctgagaatgcatcactaggcccaaccaatggatctaaattaatgaatcgtcaaggatgaaatgctgccccatttctcatggatgtcctgagaccaagaggggagatccaggagaaagaggccatggaaagcaggctggagtgaggaggaatggtcatgcttccttggaagactttctcttcttgtcaggagtgactcccaagctcttggtcggccgaagaaaaactgaggataacatttgctgactgggctttaaggagcatgatttatggaccccttaacctacccgtgccctgcaagaggctggcttcttggtcaatcttgactagattaagagtcaatctgcaagccattttatggtctccctggccagctgggggctgtagggccctgctgggcttggtcgtctttcactcctgaggcctgctctgtggctccatagctcagtcctccatcactctgcgtggatcctgggtactttggacagtgagggttcgatccaattttaggggtagggttgggggtgggagtgggagtgtgggttggcaggaggaagaatgagtctactttggagacaattaagtcatggtacgtttcctaaagatagggaacggaagaaaagcaagagaactgtttaatatgctgattattttagtctattttagaccttgagtaaactaatttagcttctaggatccaagtttccttatttgtgaaacaggaaaaaaaaattcttgtaggtattactgtttgtgtgtttgagtttactgcacatgtttgtgtttgtgtatatgtgtcttttaaaaatactatatataaagaagattctggttgttattttagacataaacgaatatatgtacctttcacaacttg

SEQ ID NO: 105453 - DNA, 5668 bp, Homo sapiens
  Payload ID: 687
  Gene Symbol: ADGRF5
  Gene Name: adhesion G protein-coupled receptor F5
  Uniprot ID: Q8IZF2
  ENST ID: ENST00000265417
  CDS Start-End: 235-4275
agagaacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaa

SEQ ID NO: 105454 - DNA, 5810 bp, Homo sapiens
  Payload ID: 687
  Gene Symbol: ADGRF5
  Gene Name: adhesion G protein-coupled receptor F5
  Uniprot ID: Q8IZF2
  ENST ID: ENST00000283296
  CDS Start-End: 290-4330
actttttgtttttaaaacagcagcgcggctctcagggatgactctgtgagactgggaggatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagccagccgggggaccacagtgctggacaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatacgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtctggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcgggagatagccctcctttgtccttctcccaaactaatgtgcagatgagcagcatggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgcccaggatatccaggaaaataactttgcagagagcttagtgatgacaaccactgtcagccacaatacaactatgccattcaggatttcaatgacttttaagaacaatagcccttcaggcggcgaaacgaagtgtgtcttctggaacttcaggcttgccaacaacacaggggggtgggacagcagtgggtgctatgtagaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaaccggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaagaaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattacaaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgag

SEQ ID NO: 105455 - DNA, 3925 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000388813
  CDS Start-End: 428-2491
agggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaa

SEQ ID NO: 105456 - DNA, 3860 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000456916
  CDS Start-End: 332-2410
gagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 105457 - DNA, 3820 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000540164
  CDS Start-End: 307-2370
ccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 105458 - DNA, 554 bp, Homo sapiens
  Payload ID: 688
  Gene Symbol: ADGRG1
  Gene Name: adhesion G protein-coupled receptor G1
  ENST ID: ENST00000568618
  CDS Start-End: 272-554
acttggtgagtggaagctgtgatcctccctctcctcttagaatctccctggattccagggcccttttcactgcaccagataagacccctgtttagtcccactcatcatctggtgtcctgccaggcatggggactgggaggatgtgggggcctgaggccaggacactgggactctcacagacgtgtcacaaggttgtcatcacagggaggaggaccagtgtgtgcaaaggcttggaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactgga

SEQ ID NO: 105459 - DNA, 571 bp, Homo sapiens
  Payload ID: 688
  Gene Symbol: ADGRG1
  Gene Name: adhesion G protein-coupled receptor G1
  ENST ID: ENST00000563548
  CDS Start-End: 195-571
acacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctg

SEQ ID NO: 105460 - DNA, 536 bp, Homo sapiens
  Payload ID: 688
  Gene Symbol: ADGRG1
  Gene Name: adhesion G protein-coupled receptor G1
  ENST ID: ENST00000568157
  CDS Start-End: 143-536
gtgtaaagggaagaaggaagcagtggatggccaggttcgtgggtcttcccggcaggagacagcagagaggcgcctgcccgggaagggttaatcccagagccgtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagg

SEQ ID NO: 105461 - DNA, 590 bp, Homo sapiens
  Payload ID: 688
  Gene Symbol: ADGRG1
  Gene Name: adhesion G protein-coupled receptor G1
  ENST ID: ENST00000568791
  CDS Start-End: 347-590
attccaggcggggcctggactgagggaggaggcaggaagaaactcacaaagagttggcagatcacggatggagggcagcatctcccaacagcctgggcggccgctgagacccagagaacccaaggactcccctgggctcatccagcagcctctgcttcccaggagagaggtgctgaagtccacgaagagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatcc

SEQ ID NO: 105462 - DNA, 567 bp, Homo sapiens
  Payload ID: 688
  Gene Symbol: ADGRG1
  Gene Name: adhesion G protein-coupled receptor G1
  ENST ID: ENST00000565013
  CDS Start-End: 211-567
aatcatctatcctcattgctcggaggaggagggcagacaggagcctctgcagggagtggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctc

SEQ ID NO: 105463 - DNA, 548 bp, Homo sapiens
  Payload ID: 688
  Gene Symbol: ADGRG1
  Gene Name: adhesion G protein-coupled receptor G1
  ENST ID: ENST00000564783
  CDS Start-End: 530-548
acttgggaacaggacaagttacggagccacgttgctttgctgggtctgagccggggtgtgacgtagtccctgcagctgccaacggttgccagggcaacggttgccaggggctgctgtcacctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgc

SEQ ID NO: 105464 - DNA, 804 bp, Homo sapiens
  Payload ID: 688
  Gene Symbol: ADGRG1
  Gene Name: adhesion G protein-coupled receptor G1
  ENST ID: ENST00000563007
  CDS Start-End: 260-553
gggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcc

SEQ ID NO: 105465 - DNA, 507 bp, Homo sapiens
  Payload ID: 688
  Gene Symbol: ADGRG1
  Gene Name: adhesion G protein-coupled receptor G1
  ENST ID: ENST00000562003
  CDS Start-End: 69-507
acaggccggtgagggacctgcccagacctggaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacct

SEQ ID NO: 105466 - DNA, 572 bp, Homo sapiens
  Payload ID: 688
  Gene Symbol: ADGRG1
  Gene Name: adhesion G protein-coupled receptor G1
  ENST ID: ENST00000566508
  CDS Start-End: 282-572
tctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaaggcagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgc

SEQ ID NO: 105467 - DNA, 944 bp, Homo sapiens
  Payload ID: 688
  Gene Symbol: ADGRG1
  Gene Name: adhesion G protein-coupled receptor G1
  ENST ID: ENST00000566271
  CDS Start-End: 351-944
aacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccc

SEQ ID NO: 105468 - DNA, 896 bp, Homo sapiens
  Payload ID: 688
  Gene Symbol: ADGRG1
  Gene Name: adhesion G protein-coupled receptor G1
  ENST ID: ENST00000568645
  CDS Start-End: 348-641
aaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaa

SEQ ID NO: 105469 - DNA, 575 bp, Homo sapiens
  Payload ID: 688
  Gene Symbol: ADGRG1
  Gene Name: adhesion G protein-coupled receptor G1
  ENST ID: ENST00000565976
  CDS Start-End: 294-575
acctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactgg

SEQ ID NO: 105470 - DNA, 594 bp, Homo sapiens
  Payload ID: 688
  Gene Symbol: ADGRG1
  Gene Name: adhesion G protein-coupled receptor G1
  ENST ID: ENST00000566164
  CDS Start-End: 246-594
agctgtctgccctgccctgccgtaggagatgggctgggagcctcccacgctctccagctcactcggcaggcagcggggaccagggctggcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcct

SEQ ID NO: 105471 - DNA, 582 bp, Homo sapiens
  Payload ID: 688
  Gene Symbol: ADGRG1
  Gene Name: adhesion G protein-coupled receptor G1
  ENST ID: ENST00000561782
  CDS Start-End: 79-582
gtaggggttggcctcctggcaaggcccagcatgacaaaggcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagt

SEQ ID NO: 105472 - DNA, 568 bp, Homo sapiens
  Payload ID: 688
  Gene Symbol: ADGRG1
  Gene Name: adhesion G protein-coupled receptor G1
  ENST ID: ENST00000563374
  CDS Start-End: 333-568
ctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgctt

SEQ ID NO: 105473 - DNA, 4254 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000568909
  CDS Start-End: 175-2256
agacaggcggagcctcacctggggctgcccgccagcccagacaagctcagactgggtgcctgtggccctgggaggaggtggaaggggaggagcaggccacacaggcacaggccggtgagggacctgcccagacctggaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactggcgtaagcattttgggtcatttccttctgagctttttcctgtgcttctattgaaagagtcactgatactaatacaaataccttggggccaatcaggaaacatgaaagagagaagagggctgtgtgtgaagaaaaaaaaaaaatcgactgctggaaacctcatcaaccagggcacaggggaagataaatggcaacttggtgtctgtgctggggaggcaatggggagtggtggggcctgtggcgaactggagactcccaaccccatgctgagagcgtggctgctcatcagctccagctggtcactaccttgcagggatgagggcccatgtagccagaccacctgccttttatgagaaatgggaaatccagactgtggtttgacatcccctgattttaaaattttggcgaatccaaaacattttctggccaaagagattacagtcaaaagctgcctggtcctgggatttatgcaaccagtttactgatcactctgcagcaggtgggctgcaagaattaaatcactggacttctctcccatccctgcctttaa

SEQ ID NO: 105474 - DNA, 565 bp, Homo sapiens
  Payload ID: 688
  Gene Symbol: ADGRG1
  Gene Name: adhesion G protein-coupled receptor G1
  ENST ID: ENST00000567397
  CDS Start-End: 271-565
agctcactcggcaggcagcggggaccagggctggcaggttaagcctctgggggtggatcctgaaaggtggtccagccgcctggccctgcgtgggaccctccacctggcagcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctact

SEQ ID NO: 105475 - DNA, 3655 bp, Homo sapiens
  Payload ID: 688
  Gene Symbol: ADGRG1
  Gene Name: adhesion G protein-coupled receptor G1
  ENST ID: ENST00000564907
  CDS Start-End: 167-460
agatcacggatggagggcagcatctcccaacagcctgggcggccgctgagacccagagaacccaaggactcccctgggctcatccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggcagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactgg

SEQ ID NO: 105476 - DNA, 4042 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000562631
  CDS Start-End: 533-2596
actttggggagactggccctgggaggcgacagatggaggctgaggaagcagagtgatccccggccccttcctgtccctgaacactgtctgcctggatgaggggtgaggctgaggtgcccccttgcccggcgctgagtcatgggcatcccccaggatcactgcctcagcgctctcagccctgccccctcctggtctccctctgagaaatccatgactcacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 105477 - DNA, 551 bp, Homo sapiens
  Payload ID: 688
  Gene Symbol: ADGRG1
  Gene Name: adhesion G protein-coupled receptor G1
  ENST ID: ENST00000568979
  CDS Start-End: 267-551
agctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcag

SEQ ID NO: 105478 - DNA, 594 bp, Homo sapiens
  Payload ID: 688
  Gene Symbol: ADGRG1
  Gene Name: adhesion G protein-coupled receptor G1
  ENST ID: ENST00000561696
  CDS Start-End: 93-594
aatcatctatcctcattgctcggaggaggagggcagacaggagcctctgcagggagtgtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacgg

SEQ ID NO: 105479 - DNA, 574 bp, Homo sapiens
  Payload ID: 688
  Gene Symbol: ADGRG1
  Gene Name: adhesion G protein-coupled receptor G1
  ENST ID: ENST00000567553
  CDS Start-End: 303-574
aactcacaaagagttggcagatcacggatggagggcagcatctcccaacagcctgggcggccgctgagacccagagaacccaaggactcccctgggctcatccagcagcctctgcttcccaggagagaggtgctgaagtccacgaagagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccagggg

SEQ ID NO: 105480 - DNA, 576 bp, Homo sapiens
  Payload ID: 688
  Gene Symbol: ADGRG1
  Gene Name: adhesion G protein-coupled receptor G1
  ENST ID: ENST00000564729
  CDS Start-End: 413-576
cacctgcgccccttctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcg

SEQ ID NO: 105481 - DNA, 622 bp, Homo sapiens
  Payload ID: 688
  Gene Symbol: ADGRG1
  Gene Name: adhesion G protein-coupled receptor G1
  ENST ID: ENST00000561969
  CDS Start-End: 144-622
gtgggaactttggggagactggccctgggaggcgacagatggaggctgaggaagcagagtgatccccggccccttcctgtccctgaacactgtctgcctggatgaggggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctc

SEQ ID NO: 105482 - DNA, 586 bp, Homo sapiens
  Payload ID: 688
  Gene Symbol: ADGRG1
  Gene Name: adhesion G protein-coupled receptor G1
  ENST ID: ENST00000563414
  CDS Start-End: 254-586
agacaactgaggtccggctgtggtttgagagggaagacagtctagaggggtcaggggagacggttcagcatcctctttgtcccttgctaccagcttggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttg

SEQ ID NO: 105483 - DNA, 553 bp, Homo sapiens
  Payload ID: 688
  Gene Symbol: ADGRG1
  Gene Name: adhesion G protein-coupled receptor G1
  ENST ID: ENST00000570044
  CDS Start-End: 342-553
ttccaggcggggcctggactgagggaggaggcaggaagaaactcacaaagagttggcagatcacggatggagggcagcatctcccaacagcctgggcggccgctgagacccagagaacccaaggactcccctgggctcatccagcagcctctgcttcccaggagagaggtgctgaagtccacgaagagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgccccttt

SEQ ID NO: 105484 - DNA, 1016 bp, Homo sapiens
  Payload ID: 688
  Gene Symbol: ADGRG1
  Gene Name: adhesion G protein-coupled receptor G1
  ENST ID: ENST00000561988
  CDS Start-End: 249-1016
agactgggtgcctgtggccctgggaggaggtggaaggggaggagcaggccacacaggcacaggccggtgagggacctgcccagacctggagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggag

SEQ ID NO: 105485 - DNA, 699 bp, Homo sapiens
  Payload ID: 688
  Gene Symbol: ADGRG1
  Gene Name: adhesion G protein-coupled receptor G1
  ENST ID: ENST00000562467
  CDS Start-End: 346-699
tgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagt

SEQ ID NO: 105486 - DNA, 855 bp, Homo sapiens
  Payload ID: 688
  Gene Symbol: ADGRG1
  Gene Name: adhesion G protein-coupled receptor G1
  ENST ID: ENST00000566169
  CDS Start-End: 394-855
gctatccaaggcaaagggacaccaaggggcaaaggtctgtgggtgggatgcctgtgctcgggggcgggcagtggtcactgtgtgtaaagggaagaaggaagcagtggatggccaggttcgtgggtcttcccggcaggagacagcagagaggcgcctgcccgggaagggttaatcccagagccgtccaggtcctgtccactcaacttccacctccatcctctgaggaaatgggttttccaggagcttggcctgggcagcggtgactcgtggctccacacggaagtgactcaggtcccccgggagaaagcgagccgtgggtccccactgcccaccgtgcagaggggcagggctgagccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgcc

SEQ ID NO: 105487 - DNA, 586 bp, Homo sapiens
  Payload ID: 688
  Gene Symbol: ADGRG1
  Gene Name: adhesion G protein-coupled receptor G1
  ENST ID: ENST00000569494
  CDS Start-End: 85-586
gtcacggggctaagtgctatccaaggcaaagggacaccaaggggcaaaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacgg

SEQ ID NO: 105488 - DNA, 602 bp, Homo sapiens
  Payload ID: 688
  Gene Symbol: ADGRG1
  Gene Name: adhesion G protein-coupled receptor G1
  ENST ID: ENST00000565314
  CDS Start-End: 181-602
cacaaagagttggcagatcacggatggagggcagcatctcccaacagcctgggcggccgctgagacccagagaacccaaggactcccctgggctcatccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcac

SEQ ID NO: 105489 - DNA, 487 bp, Homo sapiens
  Payload ID: 688
  Gene Symbol: ADGRG1
  Gene Name: adhesion G protein-coupled receptor G1
  ENST ID: ENST00000562414
  CDS Start-End: 361-487
agttgtcgccctgacctggggggtgggcggacagcatccaagggccctgttgccgtggcaaccccggcctctctgtgggaactttggggagactggccctgggaggcgacagatggaggctgaggaagcagagtgatccccggccccttcctgtccctgaacactgtctgcctggatgaggggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacaca

SEQ ID NO: 105490 - DNA, 578 bp, Homo sapiens
  Payload ID: 688
  Gene Symbol: ADGRG1
  Gene Name: adhesion G protein-coupled receptor G1
  ENST ID: ENST00000569154
  CDS Start-End: 224-578
aatcccagagccgtccaggtcctgtccactcaacttccacctccatcctctgaggaaatgggttttccaggagcttggcctgggcagcggtgactcgtggctccacacggaagtgactcaggtcccccgggagaaagcgagccgtgggtccccactgcccaccgtgcagaggggcagggctgagccaggtggtgacttccaagagtgactccgtcggaggaaaatgactccccagtcgctgctgcagacgacactgttcctgctgagtctgctcttcctggtccaagcccctgccacggggtcccatctgcagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctcta

SEQ ID NO: 105491 - DNA, 533 bp, Homo sapiens
  Payload ID: 688
  Gene Symbol: ADGRG1
  Gene Name: adhesion G protein-coupled receptor G1
  ENST ID: ENST00000564722
  CDS Start-End: 141-533
ggttggtactgagcgcctgatggctgaggccctgtagcgctggggatctgcggctccagaggcagagacagccatgcctactgacagtgaaggctcactttgaaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcag

SEQ ID NO: 105492 - DNA, 591 bp, Homo sapiens
  Payload ID: 688
  Gene Symbol: ADGRG1
  Gene Name: adhesion G protein-coupled receptor G1
  ENST ID: ENST00000565770
  CDS Start-End: 322-591
agctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcccctgccacggggtcccatctgcagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctg

SEQ ID NO: 105493 - DNA, 3858 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000562558
  CDS Start-End: 352-2415
aaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagc

SEQ ID NO: 105494 - DNA, 690 bp, Homo sapiens
  Payload ID: 688
  Gene Symbol: ADGRG1
  Gene Name: adhesion G protein-coupled receptor G1
  ENST ID: ENST00000567154
  CDS Start-End: 343-690
cacatatatcgtccgtcatccccagtcaagctcagggaggagggaggagcccagctggggcaggagaggggtgtctccccaccaaacaaacccggtccctccctctccgcactagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtacccaaacaagggctggacagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcc

SEQ ID NO: 105495 - DNA, 560 bp, Homo sapiens
  Payload ID: 688
  Gene Symbol: ADGRG1
  Gene Name: adhesion G protein-coupled receptor G1
  ENST ID: ENST00000568531
  CDS Start-End: 184-560
ttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcga

SEQ ID NO: 105496 - DNA, 561 bp, Homo sapiens
  Payload ID: 688
  Gene Symbol: ADGRG1
  Gene Name: adhesion G protein-coupled receptor G1
  ENST ID: ENST00000565391
  CDS Start-End: 1-561
ctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtctttggcacctatgtccctggctacctactcaagctgagcgccatgggctggggcttccccatctttctggtgacgctggtggccctggtggatgtggacaactatggccccatcatcttggctgtgcataggactccaga

SEQ ID NO: 105497 - DNA, 563 bp, Homo sapiens
  Payload ID: 688
  Gene Symbol: ADGRG1
  Gene Name: adhesion G protein-coupled receptor G1
  ENST ID: ENST00000565587
  CDS Start-End: 415-563
aaaatgagatggttggtgaccccagaggacaaacctgggttgtgctttctgagccatctcctggtgctgagcacttggaccgcttcagctctccacgggtcaggctggacagccctgtgaccacagcttgtcactggagtgtcttttcttcagggcccctcttgagtaggaggagaccaggctttgaaggttcctgagaggagatgtacgggacctgaatacagctttcctgacctgcccctcataggagcctgcagggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacc

SEQ ID NO: 105498 - DNA, 593 bp, Homo sapiens
  Payload ID: 688
  Gene Symbol: ADGRG1
  Gene Name: adhesion G protein-coupled receptor G1
  ENST ID: ENST00000567702
  CDS Start-End: 272-593
atggaggctgaggaagcagagtgatccccggccccttcctgtccctgaacactgtctgcctggatgagggctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagc

SEQ ID NO: 105499 - DNA, 3741 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000567835
  CDS Start-End: 214-2295
ggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaa

SEQ ID NO: 105500 - DNA, 555 bp, Homo sapiens
  Payload ID: 688
  Gene Symbol: ADGRG1
  Gene Name: adhesion G protein-coupled receptor G1
  ENST ID: ENST00000566778
  CDS Start-End: 246-555
cagactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctg

SEQ ID NO: 105501 - DNA, 478 bp, Homo sapiens
  Payload ID: 688
  Gene Symbol: ADGRG1
  Gene Name: adhesion G protein-coupled receptor G1
  ENST ID: ENST00000562682
  CDS Start-End: 247-478
agtcgaggggaaggacaggagagaggtggcagagctgcagcagggttggtgtaggggttggcctcctggcaaggcccagcatgacaaaggcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgctt

SEQ ID NO: 105502 - DNA, 618 bp, Homo sapiens
  Payload ID: 688
  Gene Symbol: ADGRG1
  Gene Name: adhesion G protein-coupled receptor G1
  ENST ID: ENST00000567915
  CDS Start-End: 265-618
tggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagt

SEQ ID NO: 105503 - DNA, 592 bp, Homo sapiens
  Payload ID: 688
  Gene Symbol: ADGRG1
  Gene Name: adhesion G protein-coupled receptor G1
  ENST ID: ENST00000563445
  CDS Start-End: 254-592
tttggggagactggccctgggaggcgacagatggaggctgaggaagcagagtgatccccggccccttcctgtccctgaacactgtctgcctggatgagggggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagt

SEQ ID NO: 105504 - DNA, 560 bp, Homo sapiens
  Payload ID: 688
  Gene Symbol: ADGRG1
  Gene Name: adhesion G protein-coupled receptor G1
  ENST ID: ENST00000565338
  CDS Start-End: 392-560
agatggaggctgaggaagcagagtgatccccggccccttcctgtccctgaacactgtctgcctggatgagggctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatct

SEQ ID NO: 105505 - DNA, 579 bp, Homo sapiens
  Payload ID: 688
  Gene Symbol: ADGRG1
  Gene Name: adhesion G protein-coupled receptor G1
  ENST ID: ENST00000566123
  CDS Start-End: 327-579
gtctctggctgctgggttaaggctcaagcttgggagcagcttcacgtgtgagggagacgagggggaggtggcgcccagtcgaggggaaggacaggagagaggtggcagagctgcagcagggttggtgtaggggttggcctcctggcaaggcccagcatgacaaaggcagacagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgacccca

SEQ ID NO: 105506 - DNA, 545 bp, Homo sapiens
  Payload ID: 688
  Gene Symbol: ADGRG1
  Gene Name: adhesion G protein-coupled receptor G1
  ENST ID: ENST00000566187
  CDS Start-End: 87-545
acagagatacttagctgagactgatggcacctgcctctaagccgtttacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagt

SEQ ID NO: 105507 - DNA, 525 bp, Homo sapiens
  Payload ID: 688
  Gene Symbol: ADGRG1
  Gene Name: adhesion G protein-coupled receptor G1
  ENST ID: ENST00000564360
  CDS Start-End: 226-525
aagtccagggcgtgaggggactggaagtgcaggaaagagccaccagtggggctgggatccaaggtcacctggggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggaga

SEQ ID NO: 105508 - DNA, 451 bp, Homo sapiens
  Payload ID: 688
  Gene Symbol: ADGRG1
  Gene Name: adhesion G protein-coupled receptor G1
  ENST ID: ENST00000569531
  CDS Start-End: 96-451
agtttcaactgcagctcttcattttaccaagagagaagtggtggcagtcctggtgtccaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcct

SEQ ID NO: 105509 - DNA, 3852 bp, Homo sapiens
  Payload ID: 688
  Gene Symbol: ADGRG1
  Gene Name: adhesion G protein-coupled receptor G1
  Uniprot ID: Q9Y653
  ENST ID: ENST00000568908
  CDS Start-End: 349-2412
aacaagagagggtggcggctgcagtggctgtggggcagccggaaatggggcgagacagacaggcggagcctcacctggggctgcccgccagcccagacaagctcagactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacct

SEQ ID NO: 105510 - DNA, 2688 bp, Homo sapiens
  Payload ID: 688
  Gene Symbol: ADGRG1
  Gene Name: adhesion G protein-coupled receptor G1
  ENST ID: ENST00000565539
  CDS Start-End: 282-575
tctcccgcgctggcggctggggcttctcagcctctattccctggctgtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccaggtggtgacttccaagagtgactccgtcggaggaaaatgactccccagtcgctgctgcagacgacactgttcctgctgagtctgctcttcctggtccaagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctg

SEQ ID NO: 105511 - DNA, 523 bp, Homo sapiens
  Payload ID: 688
  Gene Symbol: ADGRG1
  Gene Name: adhesion G protein-coupled receptor G1
  ENST ID: ENST00000569158
  CDS Start-End: 157-523
agcgctggggatctgcggctccagaggcagagacagggccaatccaggagggctgaagtgacacggtggttctgctttgtccttcagccatgcctactgacagtgaaggctcactttgaaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttcc

SEQ ID NO: 105512 - DNA, 547 bp, Homo sapiens
  Payload ID: 688
  Gene Symbol: ADGRG1
  Gene Name: adhesion G protein-coupled receptor G1
  ENST ID: ENST00000564338
  CDS Start-End: 204-547
agctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgactt

SEQ ID NO: 105513 - DNA, 601 bp, Homo sapiens
  Payload ID: 688
  Gene Symbol: ADGRG1
  Gene Name: adhesion G protein-coupled receptor G1
  ENST ID: ENST00000563862
  CDS Start-End: 109-601
gtggttggtactgagcgcctgatggctgaggccctgtagcgctggggatctgcggctccagaggcagagacaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttct

SEQ ID NO: 105514 - DNA, 734 bp, Homo sapiens
  Payload ID: 688
  Gene Symbol: ADGRG1
  Gene Name: adhesion G protein-coupled receptor G1
  ENST ID: ENST00000569101
  CDS Start-End: 138-734
gcagaggcagggcccttgcctgtggggccgtggttggtactgagcgcctgatggctgaggccctgtagcgctggggatctgcggctccagaggcagagacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggagg

SEQ ID NO: 105515 - DNA, 563 bp, Homo sapiens
  Payload ID: 688
  Gene Symbol: ADGRG1
  Gene Name: adhesion G protein-coupled receptor G1
  ENST ID: ENST00000569372
  CDS Start-End: 232-563
acacaggcacaggccggtgagggacctgcccagacctggaggagcgacgatgcctcactgcctgaccagaggcacctgacaccaggcctggcatccgagcagctgccactcagacctcacaggccagggccaagggagctgctgatgcaagaggcacaattttaggggcaagagcagcaagtaggatggtcttgaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttctt

SEQ ID NO: 105516 - DNA, 558 bp, Homo sapiens
  Payload ID: 688
  Gene Symbol: ADGRG1
  Gene Name: adhesion G protein-coupled receptor G1
  ENST ID: ENST00000564103
  CDS Start-End: 354-558
gtcccctttgtttgaagctccagtgagggagcagtggctggggtggcccagcttcaaagtctctgtcctcttgaaaaaaggtggtcgggggacattgacccaccagccccgcaggctactgcctgcaaacaagaacccctcatctgccacgcacgttcttaatgtatctatagtctgcctgatgccacaaaggagtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaagcctctagcctcctctgcttccagcaccaggaggagagcctggctcagggccccccgctgttagccacttctgtcacctcctggtggagccctcagaacatcagcctgcccagtgccgccagcttcaccttctccttccaca

SEQ ID NO: 105517 - DNA, 640 bp, Homo sapiens
  Payload ID: 688
  Gene Symbol: ADGRG1
  Gene Name: adhesion G protein-coupled receptor G1
  ENST ID: ENST00000568234
  CDS Start-End: 207-640
actagctgtctgccctgccctgccgtaggagatgggctgggagcctcccacgctctccagctcactcggcaggcagcggggaccagggctggcaggttaagcctctgggggtggatcctgaaaggtggtccagccgcctggccctgcgtgggaccctccacctggcagcaggtggtgacttccaagagtgactccgtcggaggaaaatgactccccagtcgctgctgcagacgacactgttcctgctgagtctgctcttcctggtccaagcctctgcctcctcaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgt

SEQ ID NO: 105518 - DNA, 937 bp, Homo sapiens
  Payload ID: 688
  Gene Symbol: ADGRG1
  Gene Name: adhesion G protein-coupled receptor G1
  ENST ID: ENST00000561833
  CDS Start-End: 451-937
gcttgtcttctctgggccaggcccctccatggtggctgaggactctttggaacagggaactgtcgtggaagaaagggcccggccctgccactgcctcctgtgggaccctgggccaggctcccctgctgtccaggcctgtttccctgtctgttccatgaaggagaggcaggggcagtggtctgtaaacccataagctgcagcagtaggcccctcccctggtctcatgggccacacacgccagccagccagagctcttcattttaccaagagagaagtggtggcagtcctggtgtccagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccaca

SEQ ID NO: 105519 - DNA, 563 bp, Homo sapiens
  Payload ID: 688
  Gene Symbol: ADGRG1
  Gene Name: adhesion G protein-coupled receptor G1
  ENST ID: ENST00000568074
  CDS Start-End: 311-563
accagtggggctgggatccaaggtcacctgggtgagttctgatgggctccctgatttgggcccttgggaggatggcgtccagctgaacccatggaaacacattgttggaagctttctttactgtgacttttcaagagatgtgctttctaagagtcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgacccca

SEQ ID NO: 105520 - DNA, 3594 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000340581
  CDS Start-End: 44-2740
tgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtag

SEQ ID NO: 105521 - DNA, 4494 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000354791
  CDS Start-End: 243-2939
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 105522 - DNA, 4630 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000356606
  CDS Start-End: 70-3081
agccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaag

SEQ ID NO: 105523 - DNA, 4678 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000357544
  CDS Start-End: 165-3128
cgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 105524 - DNA, 4661 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000357991
  CDS Start-End: 67-3111
cccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 105525 - DNA, 4702 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000360279
  CDS Start-End: 165-3152
cgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagatgttactttaagcttactcccttcaaacgaaacaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 105526 - DNA, 4768 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000379869
  CDS Start-End: 165-3218
cgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 105527 - DNA, 4698 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000379873
  CDS Start-End: 243-3143
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatggtactccagaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 105528 - DNA, 4779 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000379876
  CDS Start-End: 243-3224
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 105529 - DNA, 4803 bp, Homo sapiens
  Payload ID: 689
  Gene Symbol: ADGRG2
  Gene Name: adhesion G protein-coupled receptor G2
  Uniprot ID: Q8IZP9
  ENST ID: ENST00000379878
  CDS Start-End: 243-3248
gcgcccagcctcgccgccgccgagcgcccgacgcgccacgccgcgctgggcagctggagagctggcggcggagcgggccgggagcggcgggggcggcgccgaggccgcgggcggggggaggagggccgcagccccggagaggggaaaaggcgggccggacggcgccagcagccagccccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgaggttgaaacaacaagcctcaatgatgttactttaagcttactcccttcaaacgaaacagaaaaaactaaaatcactatagtaaaaaccttcaatgcatcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgtaatagctgctttggaaagagtaaagattcgaccaatggaacactgctgctgttctgtcaggataccctgcccttcctccccagaagagttggaaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggctcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatcttt

SEQ ID NO: 105530 - DNA, 2728 bp, Homo sapiens
  Payload ID: 690
  Gene Symbol: ADGRG3
  Gene Name: adhesion G protein-coupled receptor G3
  Uniprot ID: Q86Y34
  ENST ID: ENST00000333493
  CDS Start-End: 162-1811
acaacccaaccaatggcgccatcgagcaggaagggtgagaaagaggacacaggaagccagagtggtggggctgcagggtgggggcaggccagctcagcagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaa

SEQ ID NO: 105531 - DNA, 1785 bp, Homo sapiens
  Payload ID: 690
  Gene Symbol: ADGRG3
  Gene Name: adhesion G protein-coupled receptor G3
  ENST ID: ENST00000450388
  CDS Start-End: 262-1551
acagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgaga

SEQ ID NO: 105532 - DNA, 2317 bp, Homo sapiens
  Payload ID: 690
  Gene Symbol: ADGRG3
  Gene Name: adhesion G protein-coupled receptor G3
  ENST ID: ENST00000567991
  CDS Start-End: 32-979
gagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaa

SEQ ID NO: 105533 - DNA, 590 bp, Homo sapiens
  Payload ID: 690
  Gene Symbol: ADGRG3
  Gene Name: adhesion G protein-coupled receptor G3
  ENST ID: ENST00000568245
  CDS Start-End: 72-281
agctcagcagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagaggtgatccaggagcttcttagcaccccagagctgttcagaggctcctctttgtgctgcccagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcac

SEQ ID NO: 105534 - DNA, 9820 bp, Homo sapiens
  Payload ID: 691
  Gene Symbol: ADGRG4
  Gene Name: adhesion G protein-coupled receptor G4
  Uniprot ID: Q8IZF6
  ENST ID: ENST00000370652
  CDS Start-End: 181-9423
aggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgagacttagacaatgaaagaacacatcatatatcagaagctttatggattgattctcatgtcgagttttatctttctctcagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggattcttcatttttgtgtttcactgtgtgatgaaggagagtgtgcgggagcagtggcagatacacctctgctgtgggtggttgcgattggataactcttctgatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 105535 - DNA, 8971 bp, Homo sapiens
  Payload ID: 691
  Gene Symbol: ADGRG4
  Gene Name: adhesion G protein-coupled receptor G4
  Uniprot ID: Q8IZF6
  ENST ID: ENST00000394141
  CDS Start-End: 151-8778
cagaaaagaaggtgactgaggcatggacagcagaaaatgagtctcctgtttagtacttctttcatttcacatcaaacataggaatttagagacaagatctggtcatttgagggtgggaagttaaaagagtccagttctcagacttagacaatgaaagaacacatcatatatcagaagctttatggattgattctcatgtcgagttttatctttctctcagttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggattcttcatttttgtgtttcactgtgtgatgaaggagagtgtgcgggagcagtggcagatacacctctgctgtgggtggttgcgattggataactcttctgatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaa

SEQ ID NO: 105536 - DNA, 9931 bp, Homo sapiens
  Payload ID: 691
  Gene Symbol: ADGRG4
  Gene Name: adhesion G protein-coupled receptor G4
  Uniprot ID: Q8IZF6
  ENST ID: ENST00000394143
  CDS Start-End: 292-9534
cagtttcttaatccagtctatcactgatggacatttggatatggagagcagatggtcaacattctcctcataaccttccagggaatggaagatacccgttgaagccctcccaggctgtgtgaccccacgttggggacaggtcacaaaacctaagccttgtgcctactggaaagaagaagcagtggagtccttgacagaagcagtggtgctggaacctggtgctaggcgctgggccaagcactttacatactgtgtgttatgtaatcttcacagcaatatgagacttagacaatgaaagaacacatcatatatcagaagctttatggattgattctcatgtcgagttttatctttctctcagatacactttcactaaaaggaaaaaagctggatttttttggaagaggtgacacatatgtaagcctgatagataccattcctgaactcagccgattcacagcatgcattgatctggtattcatggatgacaactcaaggtattggatggccttctcttatattactaataacgccctcctgggcagagaagacatagaccttggacttgcaggagaccatcagcagctaatactatacagattgggaaagaccttttctatccgtcaccacctggcttcatttcaatggcatacaatatgcttgatatgggatggtgtgaagggcaaattagaactcttcctgaataaagaaaggatactggaagtaacggatcaaccacacaacctgacacctcatgggactctgttcctagggcactttctcaagaatgagagcagcgaggttaaaagcatgatgcgtagctttcctggcagcttgtactactttcaactctgggaccacatcctggaaaacgaagagtttatgaagtgtttagatggaaatatagttagttgggaagaagacgtctggcttgtcaacaagatcatcccaactgttgacaggacactgcgctgctttgttcctgaaaatatgacaattcaagaaaaaagtacaactgtttcacaacagatagatatgaccactccatcccaaattactggagtaaaaccacaaaatactgcacattcctctacactattgtctcaaagcatacctatatttgcaactgattacacaaccatatcatattccaatacaacatctccacctctggaaacaatgactgcacaaaaaatcttaaagacactggtagatgagacagctacatttgcagtggatgttttatcaacttcatcagccatctctctgcctacccagagtatatccatagacaatactaccaattccatgaaaaaaacgaaatctccatcttcagaaagcacaaagacaacaaaaatggttgaagccatggctactgaaatctttcaaccacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacgacccctgtaccaaagtcagcaacaacacaaagattaaatgccactgtgacaagaaaagaagcaacttcccattatcttatgagaaaatcaactatagcagcagtggctgaggtttctccattttcaacaatgctggaagtgacagacgaatcagcacaaagggtgacagcttctgtcactgtttcctcttttcctgatatagaaaagctaagtaccccattggataataaaactgcaacaactgaggtgagagaaagttggcttttgacaaaattggtgaaaaccacacctaggagttcatacaatgaaatgacagaaatgtttaattttaaccacacctatgtagcacattggacttcagagacatctgagggaatttcagctggatctcccacttctgggagcacacatatattcggtgaacccctgggtgcttctaccacaaggatatcagaaaccagtttctccactacccctacagacaggacagctacgtccttgtctgatggtatcttacctccacagcctacagctgctcattcctcagcaacccctgtgcctgttactcatatgttctcattgccagttaatggcagttctgtggtggctgaggagactgaggttaccatgtctgagccttctacactggccagggctttttctacatctgtgctctcagatgtctcaaatctatcctcaactacaatgaccacagcattggtaccacctttggatcagactgcttccacaaccattgttattgtgcctacccatggagacttgattcgtaccacttcagaggccacggtaatctctgtcaggaagacatccatggcagttccttctctgacagaaacaccatttcattcactgagactctccactcctgtgacagctaaggctgagaccacccttttctctacctcagttgatacagtaaccccatctacacacactcttgtctgctcaaaacctccccctgacaacattcctcctgcgtcctccactcatgtgatctcaactacgtctacaccagaagcaactcaaccaatatctcaagtagaggagacttctacctatgctctcagcttcccatatactttcagtggtggtggagttgttgccagcttggctactggcaccacagagacctctgttgttgatgagaccacaccctcacacatctctgccaataagttgactacttcagtaaacagtcacatttcttcatctgccacatatcgtgtacacacaccagtgtccatccagttggtgactagcacctctgtcttatcttccgacaaagaccagatgaccatatccctgggaaaaacccctagaactatggaggtgacagaaatgtccccatcaaagaattcttttatttcatactcccggggtactccatctttggaaatgacagatacaggatttcctgagaccacaaaaatttccagtcaccaaacacattcgccttcagagattccacttgggactccctctgatggaaatttggcttcatctcccacttctggaagcacacagattacaccaaccttgacctcaagtaacacagtaggtgttcacattccagaaatgtctaccagtcttgggaaaacagctctcccctcacaagctctgacaatcaccacttttttgtgtcctgaaaaggaaagcacgagtgcccttccagcatatactcccaggactgtggaaatgatagtaaactccacctatgtgactcactctgtctcatatggccaggatacttcatttgtagataccacaacttccagctcaacaaggatatcaaatcctatggacatcaatacaactttttcacacttgcattcacttaggacacaacctgaggtgacttcagttgcctctttcatttctgaaagcacacagactttccctgagtccttgtctctttccacagctggactatataatgacggttttacagttctctccgacaggatcactacagccttttctgttccaaatgtacctacaatgcttcctagagaatcctctatggcaacgtccactcctatttaccagatgtcctcattgccagttaatgtaactgccttcacctccaaaaaagtttctgacactcccccaatagtgataactaaatcttctaaaacaatgcatccaggttgtttgaaaagtccctgtacagccacttctgggcctatgtctgagatgtcctcaataccagttaataactctgctttcacacctgcaacagtctcttctgacacttccacaagagttgggttattctctactttattgtcttcagttacccccaggactactatgaccatgcaaacatctacattggatgtcacacctgtgatatatgctggggctacttcaaaaaacaaaatggtttcctctgctttcactacagaaatgatagaggcaccttccaggatcacacctacgacctttctctctccaacagagccaactttgccctttgtaaaaaccgttcccaccaccattatggctgggatagtgactccatttgtaggcaccactgccttctctccactcagttctaagagcactggagctatttcctccattccaaagaccacattttcaccatttctatcagcaactcaacagtcatcacaagcagatgaggctacaactttgggcatattatctgggattactaacaggtccctatctactgtgaacagtggtacaggggtagctctcacagatacttattccagaatcactgttcctgaaaatatgctttcacctactcatgcagatagtctccatacttccttcaatattcaggtttccccatctctgactagctttaagagtgcttctggacccacaaaaaatgttaaaacaaccaccaattgcttttcttctaatactagaaagatgacttccttgttagaaaagacttccttaacaaactatgccacatctttgaatacccctgtttcataccctccatggaccccatccagtgcaactctaccctctttgacatcatttgtttattcacctcatagtactgaagctgagatctctactccaaagacctctcctcctcccacatcccaaatggttgaatttccagttctgggaacaagaatgacatctagtaatacccaacctctgcttatgacttcctggaacatacccacagctgaaggttctcagtttccaatttccaccactattaatgtacctacatccaatgagatggaaacagagactctacaccttgttcctgggcctttgtcaacattcacagcctctcagactggtctagtatctaaagatgtcatggcaatgtcatcaattcctatgtcaggaattcttcctaaccatgggctttctgagaacccttcattatcaacatctttaagagctatcacttccacattggctgacgttaagcacacatttgagaaaatgaccacatctgtaactcctgggaccacactcccatcaattctttctggtgccacttcaggatctgtaatttcaaagtcacccattctgacatggctcttatctagtctcccttctggctcccctccggcaactgtatctaatgcccctcatgttatgacttcctctacagtagaggtgtcaaaatcaacatttctgacatctgacatgatatcagcgcacccattcactaacttgacaacactaccctctgctactatgagcaccatactcacccgaaccattcctacacctacactgggtggtatcactactggcttcccaacttctctccctatgtctataaatgtcacagatgacattgtgtacatttccacacaccctgaggcatcctccagaaccacaataactgccaaccccaggactgtgtctcatccttcatccttcagcagaaagactatgtcaccttctacaactgaccacactctatctgttggtgccatgcctctgcctagctctacaataacatcttcatggaacagaattccaactgcatcatcaccctctactttaattattcctaagcccacactggactcccttctaaatataatgactactacatccactgttcctggagcctcatttccactcatatccactggggtgacatatccttttacagcaactgtgtcttcaccaatatcgtccttttttgaaacaacttggctggactccacaccttcctttctatctacggaagcatcgacttcgcctactgccaccaagtccacagtttccttctacaatgttgaaatgagcttctctgtctttgttgaagagccaaggatccctattaccagtgttataaatgaatttacggaaaattcgttgaattctatatttcagaacagtgaattttctcttgctactctggaaacccaaattaaaagcagggacatttcagaggaagagatggtcatggatcgagctattttggaacagagagaaggacaagaaatggctacaatttcctatgtaccatacagttgtgtttgtcaggtcatcataaaagccagctcttccttagcatcctctgaattgatgagaaaaatcaaaagtaaaatacatggcaacttcacacatggaaacttcacacaagatcaattgacgttattagtaaactgtgaacacgttgcagtgaaaaaactagagcctggaaattgcaaagctgatgaaacagcctctaaatacaaagggacctataagtggctattaaccaaccctacggagacagcccaaaccagatgcataaaaaatgaggatggaaatgccacaagattctgttcaatcagcatcaacacgggcaaatctcagtgggaaaagccaaagtttaaacaatgcaaattgcttcaagaacttcctgacaagattgtggatcttgctaatattaccataagtgatgagaatgctgaggatgttgcagagcatattttaaatttgataaatgaatccccagccctgggtaaagaagagacaaagattattgtttctaaaatatcagatatttcacaatgtgatgagataagtatgaacctaactcatgttatgttacaaataatcaacgttgttttggaaaagcaaaacaattccgcctctgatctgcatgaaataagcaatgaaattctgaggataattgagcgtactggtcacaagatggagttttctgggcagatagcaaatctgacggtggccgggctggctttggctgtgctgcggggggaccacacgtttgatggcatggctttcagcattcactcctatgaagaaggcacagaccctgagattttcctaggcaatgtccctgtgggagggattttggcttccatatatttgcctaaatcactgacggagagaattcctcttagcaacttacaaacgatcttgtttaatttctttggccaaacttcactctttaagaccaaaaatgtcactaaagcattaaccacctatgttgtgagtgccagcatttcagatgatatgttcattcaaaacttagctgacccagtggttatcactctgcagcatattggaggaaaccagaattatggtcaagttcactgtgccttttgggattttgagaataataatgggctgggtggatggaattcgtcaggctgtaaagtaaaggaaacaaatgtaaattacacaatctgtcagtgtgaccacctcacccattttggagtcttaatggatttatccaggtctacagtggattcagtgaatgaacagatattagcgcttataacatacaccggatgtggaatctcctccatttttctgggagttgcagtggtgacatacatagcttttcacaaacttcgaaaagattatcctgccaaaattctgatcaacctgtgcacagcactactgatgctaaacctggtatttttgatcaattcttggttgtcatcatttcagaaagtgggagtttgtatcacagctgcagtggcacttcattacttcctgcttgtttcttttacttggatgggcctggaggcagtccacatgtatttggctctagtcaaagtcttcaacatatacattccaaattatatccttaaattttgtctagttggttggggaatcccggctatcatggtggcaatcacagtcagtgtgaaaaaagatctgtatggaactctgagcccaacaactccgttttgttggattaaagatgattctatcttttacatctcagtggtggcttatttttgcctcatatttctcatgaatctctccatgttctgcactgttcttgttcaactgaattctgtgaaatcccaaatccagaagactcggcggaagatgatcctgcatgacctcaaaggcacaatgagcctgacattcttacttggcctcacctgggggtttgcattttttgcttggggacccatgaggaactttttcttgtatttgtttgccatttttaacactttgcaaggattcttcatttttgtgtttcactgtgtgatgaaggagagtgtgcgggagcagtggcagatacacctctgctgtgggtggttgcgattggataactcttctgatgggagcagccggtgtcagataaaggttggatataaacaggagggactaaagaaaatctttgagcacaaactgttgacgccatctctcaagtcaactgcaactagctccactttcaaatctttaggctctgcacaaggcacaccttcagaaataagctttccaaatgatgactttgacaaagatccttactgttcctctccttgatttgtgaagttgtgcctaattatgtaaaaagaatataatacctgtggaaataaaaatgaattccaagtgtatacttgctcgggtgatgggtgcaccaaaatctcacaaatcaccactaaataatgtactcatgtaaccaaatgctacctgttccaccaaaacctatggaaatttaaaaaaaacaaaaataaaaagcaaaacaaaaatcccaaaatgaattccattcacaaacagaatttttcaataaatcccagtagagatacttgcctcctcccaacccctgattggggaaaaggttgaatttgtgaaacaatctgctccaaccttctattttaattattattttgtaaggggaagaataacatttgataaatattaaagtcagaataattctcct

SEQ ID NO: 105537 - DNA, 3557 bp, Homo sapiens
  Payload ID: 692
  Gene Symbol: ADGRG5
  Gene Name: adhesion G protein-coupled receptor G5
  Uniprot ID: Q8IZF4
  ENST ID: ENST00000349457
  CDS Start-End: 320-1906
agtagctgcagactctacggggtgataccctcaaagggtgaccagggcatgaccgacagctcgaaggaagcaaagaggctgctgctggtgaaagaagaagtgaagtgagagtgtggtgcctgggcctggggtgaagggagcagagagaagtgcagtgggggtgcaggtgtggggcaaagggagaggccacccacagacgcctcccgacttccccttcttcctgcagaagctacaagacagcagccgagacagcagctgagacggcagcggcagcttctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtttcttccttttcctgtggttctgctcccagcggtgccgctcagaagcagaggccaaggcacagatagaggccttcagctcctcccaaacaacacagtagtccgggcctcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactgcgcctactgagtgacccatttcctccaggaggaaaggcaagacacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaa

SEQ ID NO: 105538 - DNA, 3767 bp, Homo sapiens
  Payload ID: 692
  Gene Symbol: ADGRG5
  Gene Name: adhesion G protein-coupled receptor G5
  Uniprot ID: Q8IZF4
  ENST ID: ENST00000340339
  CDS Start-End: 524-2110
ggcagcttctcaggtcagcctcctccgggcctctccccactctcctctgcccagttctctgtccttatccacaggcccctcagtgggcactggccatacccatgtccaggtgggcacagacctggtgatatcctggtgagcaagctggggacccaccctccttccctttctggttggcagctccacatctggggcaatgtagagatctgtgcttttggaaggaggggcaatttaaattaagaagtggttaggcatgggtctcgaatcttagcttccccgcgaggtctgggacaagtgaagagaggtttcttttctggacctcagtttctcatctgtaaaatggggtgagtctgggaacctgcaccttggatggctgtcaggggctcagtagaggacctggcacacagtttgtgcttggcaatctggagcaggtgcagctcctttcagagtgacctggattggatcctggggacagcatgtctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggaaggctacaccctgacctgtgtcttctggaaggagggagccaggaaacagccctgggggggctggagccctgagggctgtcgtacagagcagccctcccactctcaggtgctctgccgctgcaaccacctcacctactttgctgttctcatgcaactctccccagccctggtccctgcagagttgctggcacctcttacgtacatctccctcgtgggctgcagcatctccatcgtggcctcgctgatcacagtcctgctgcacttccatttcaggaagcagagtgactccttaacacgcatccacatgaacctgcatgcctccgtgctgctcctgaacatcgccttcctgctgagccccgcattcgcaatgtctcctgtgcccgggtcagcatgcacggctctggccgctgccctgcactacgcgctgctcagctgcctcacctggatggccatcgagggcttcaacctctacctcctcctcgggcgtgtctacaacatctacatccgcagatatgtgttcaagcttggtgtgctaggctggggggccccagccctcctggtgctgctttccctctctgtcaagagctcggtatacggaccctgcacaatccccgtcttcgacagctgggagaatggcacaggcttccagaacatgtccatatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtttcttccttttcctgtggttctgctcccagcggtgccgctcagaagcagaggccaaggcacagatagaggccttcagctcctcccaaacaacacagtagtccgggcctcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactgcgcctactgagtgacccatttcctccaggaggaaaggcaagacacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaatggtta

SEQ ID NO: 105539 - DNA, 762 bp, Homo sapiens
  Payload ID: 692
  Gene Symbol: ADGRG5
  Gene Name: adhesion G protein-coupled receptor G5
  ENST ID: ENST00000615867
  CDS Start-End: 54-719
gcggcagcttctcagggccggagccagttcttggaggagactctgcacagggcatggatcactgtggtgcccttttcctgtgcctgtgccttctgactttgcagaatgcaacaacagagacatgggaagaactcctgagctacatggagaatatgcaggtgtccaggggccggagctcagttttttcctctcgtcaactccaccagctggagcagatgctactgaacaccagcttcccaggctacaacctgaccttgcagacacccaccatccagtctctggccttcaagctgagctgtgacttctctggcctctcgctgaccagtgccactctgaagcgggtgccccaggcaggaggtcagcatgcccggggtcagcacgccatgcagttccccgccgagctgacccgggacgcctgcaagacccgccccagggagctgcggctcatctgtatctacttctccaacacccactttttcaaggatgaaaacaactcatctctgctgaataactacgtcctgggggcccagctgagtcatgggcacgtgaacaacctcagggatcctgtgaacatcagcttctggcacaaccaaagcctggtactgctgggggcgcccccgtttccactgcacccctgcccctctgtgactctcctgttgaacactggtttgactagacccaaacctgtggaaccatcttggaaatccatcacactttgaaaattcctgctcaagaaataagagagagagaagtttttactca

SEQ ID NO: 105540 - DNA, 7026 bp, Homo sapiens
  Payload ID: 693
  Gene Symbol: ADGRG6
  Gene Name: adhesion G protein-coupled receptor G6
  Uniprot ID: Q86SQ4
  ENST ID: ENST00000230173
  CDS Start-End: 477-4142
ccagctccagtcacgccggaagcgcgggcggagcgcacgggtccggggagagtcgcctgcgcccgcgagggggacccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagttattcaa

SEQ ID NO: 105541 - DNA, 6849 bp, Homo sapiens
  Payload ID: 693
  Gene Symbol: ADGRG6
  Gene Name: adhesion G protein-coupled receptor G6
  Uniprot ID: Q86SQ4
  ENST ID: ENST00000296932
  CDS Start-End: 402-3983
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 105542 - DNA, 6879 bp, Homo sapiens
  Payload ID: 693
  Gene Symbol: ADGRG6
  Gene Name: adhesion G protein-coupled receptor G6
  Uniprot ID: Q86SQ4
  ENST ID: ENST00000367608
  CDS Start-End: 472-4140
tccagtcacgccggaagcgcgggcggagcgcacgggtccggggagagtcgcctgcgcccgcgagggggacccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttc

SEQ ID NO: 105543 - DNA, 6887 bp, Homo sapiens
  Payload ID: 693
  Gene Symbol: ADGRG6
  Gene Name: adhesion G protein-coupled receptor G6
  Uniprot ID: Q86SQ4
  ENST ID: ENST00000367609
  CDS Start-End: 402-4154
ccaagtacctagggtggtggccgagtcccgcctcccgccagcgggggcgaggacctgcgacgcgcacccctgcctggcccggtctcctcagcaccagccccacgcacaccctacttcctcagcttctcgccctcaccctgccaacttccctgcgaggagggacctgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaaacattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcagcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttc

SEQ ID NO: 105544 - DNA, 540 bp, Homo sapiens
  Payload ID: 693
  Gene Symbol: ADGRG6
  Gene Name: adhesion G protein-coupled receptor G6
  ENST ID: ENST00000435011
  CDS Start-End: 116-540
aaaacgtgttttcaattcaaattaaacaaggagtaacaggcaccgctcctcagtccagaggcctggccctgccaagaaggcgctctccggaatcaacacctgggggcttggaaggatgtttcgctcagatcgaatgtggagctgccattggaaatggaagcccagtcctctcctgttcttatttgctttatatatcatgtgtgttcctcactcagcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggttt

SEQ ID NO: 105545 - DNA, 652 bp, Homo sapiens
  Payload ID: 693
  Gene Symbol: ADGRG6
  Gene Name: adhesion G protein-coupled receptor G6
  ENST ID: ENST00000540208
  CDS Start-End: 1-311
cacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtatttccagttattatctttcactacgtgttttgagaaaacctcaaaatctgctgctgatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagag

SEQ ID NO: 105546 - DNA, 583 bp, Homo sapiens
  Payload ID: 693
  Gene Symbol: ADGRG6
  Gene Name: adhesion G protein-coupled receptor G6
  ENST ID: ENST00000508295
  CDS Start-End: 1-407
aggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttggaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatggtaatattttcactgactcttgccagcaaagctacatgttatcagccttcccagggttatacgtgcagcacggtagttcttaggcattatattgattgcaaagaagggcaggaatctctgtgtatgcctgtatcattcactcctggggaataaagataacataagtggatgactcagaaa

SEQ ID NO: 105547 - DNA, 844 bp, Homo sapiens
  Payload ID: 693
  Gene Symbol: ADGRG6
  Gene Name: adhesion G protein-coupled receptor G6
  ENST ID: ENST00000541199
  CDS Start-End: 121-844
tggggaaaacgtgttttcaattcaaattaaacaaggagtaacaggcaccgctcctcagtccagaggcctggccctgccaagaaggcgctctccggaatcaacacctgggggcttggaaggatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaag

SEQ ID NO: 105548 - DNA, 3140 bp, Homo sapiens
  Payload ID: 694
  Gene Symbol: ADGRG7
  Gene Name: adhesion G protein-coupled receptor G7
  Uniprot ID: Q96K78
  ENST ID: ENST00000273352
  CDS Start-End: 269-2662
ataactctaatcacttttttcatgttctccttgagtgaaggatgaggaaattgaaagcagagtatgcaccttttattaggagattcaaactgcatcctactggattagcctcaaaagtcctaaaatacaaagacatccatctgacagatcactgaggggaggacttgtttttctgttttagaatagtttccgattaaactttttagctcaagaagaaaagaagctagttatttctcacccaggagtggatttgtggtttggcttcaccatggcttcctgccgtgcctggaaccttagggtgctggtggctgtcgtgtgtggactactgactggcatcattttgggactgggcatctggaggattgtgatcaggatccaaagaggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtaaaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgttaaatctttgtgacacactttgacaaaaatgtagaacctataacaaattcttttacaagttactataaaggacacaaagagaaaactttaccttccagaacaaaatgactcctgatgaacagtgtgtggggatttgcttgtatgtattaaacttttgacctctgaatattttacagtcgtatgtgcttgtacttttatttccaatgaagaatttggcaccaa

SEQ ID NO: 105549 - DNA, 2035 bp, Homo sapiens
  Payload ID: 694
  Gene Symbol: ADGRG7
  Gene Name: adhesion G protein-coupled receptor G7
  ENST ID: ENST00000475887
  CDS Start-End: 270-1778
ttatttacctgcagttgcttacaaagtgtttggacataattgtgtaaagctagggttttttttctggtttttaaaacaggtaaaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgtt

SEQ ID NO: 105550 - DNA, 7853 bp, Homo sapiens
  Payload ID: 695
  Gene Symbol: ADGRL1
  Gene Name: adhesion G protein-coupled receptor L1
  Uniprot ID: O94910
  ENST ID: ENST00000340736
  CDS Start-End: 299-4723
tctttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacaaagtggagcagaaagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaaagaaaaaaaaaagacaaaaaaaaaaaaaaagaaaagaaaaaaaatctcatcacttgaagccaccgggagcctgcggcccgggccagcccgggctttctccggagcagagcagcgctgctggcctggcagccaggacttctccgtgtacgtgcatccccagtccccgccggggcgggcgggccgccagagcagctttttacaatccagagacagaaaacaaaatctagatgcaacagcgaaacaaagaacccatttccttcctggcaccctcctttcctgctccgcctgcccggcatcatcagcccttctggggcgtgtacctctcactgcctgccccaggaccagaggcctgtctcccccttccctccccaccggcccgggggagacctcttcacacccaaagatgctttgtcaagatggctgcgctgtccctttgagttcctgcttcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcagggaagacgaagccaggtgccagggctggggtcgggacacccatgttctgggcggcttgaccccaaatcccagaccccggaagctccaggctcgggatgtgtcctgagcacctgtcccggccccctcctctccagcctgtcaggccagcctccccagcccccttccctcaactctaggggcagcatagccccaggccaccctagcccagcccctgcattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaa

SEQ ID NO: 105551 - DNA, 5610 bp, Homo sapiens
  Payload ID: 695
  Gene Symbol: ADGRL1
  Gene Name: adhesion G protein-coupled receptor L1
  Uniprot ID: O94910
  ENST ID: ENST00000361434
  CDS Start-End: 281-4690
ctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgtaacaaccgcacccagtgcgtggtggtcgccggctcggatgcctttcctgacccctgtcctgggacctacaagtacctggaggtgcagtacgactgtgtcccctacatcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggcccagccacttccccacccctcagcacgaccaccacagccaggcccacgcccctcaccagcacagcctcgcccgcagccaccaccccgctccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgaggaattgcctccttccagtgtctaccagccttggggctctggaacccccggggccctgacctcagcaactgcacctccccctgggtcaaccaggtggcccagaagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcaggagctggtgttcccccaggaggagtacccgagaaagaactccatccagctgtctgccaaaaccatcaagcagaacagccgcaatggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatctaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcctgctggctccgagtggacaattacttcatctggagtttcatcgggccagtctccttcgttatcgtggtcaacctggtgttcctcatggtgaccctgcacaagatgatccgaagctcatctgtgctcaagcccgactccagccgcctggacaacattaaatcctgggcgctgggggccatcgcgctgctgttcctgctgggcctcacctgggctttcggcctcctcttcatcaacaaggagtcggtggtcatggcctatctcttcaccaccttcaacgccttccagggggtcttcatcttcgtctttcactgcgccttacagaagaaggtgcacaaggagtacagcaagtgcctgcgtcactcctactgctgcatccgctccccacccgggggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagagggagcagtgaggcaggacagatggacaggttcctcctgcgctgtaattccctgctccctggagactgggaaaaggccgcagggcagggggactgggcggtggtggctggtggtttaaaggttgaactttctctgaagctcctttccccttgctcttggtccctgccccgcaagcaaacctgccccctctgcctcccagtgcacccaatgaccccctcccttggggcgactcctgatgaagcacaactccccgcagggcccccagcccacaggggtggccatatttgggcagttcccagtcctgtgggctcggctatctggggagcagattttgggtctggatctccctggggagtgggtcctgggcttggatctttccctagggggccctcttactccttcctctctcctcctccttccccattgctgtaaatatttcaacgaaatggaaa

SEQ ID NO: 105552 - DNA, 791 bp, Homo sapiens
  Payload ID: 695
  Gene Symbol: ADGRL1
  Gene Name: adhesion G protein-coupled receptor L1
  ENST ID: ENST00000592164
  CDS Start-End: 1-791
gggcactcacggatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagaactggagcctggacttgcatttcgagctcatccttgccttttctcttctctcttctggctgccacctgcagggagctaccgggaacccaagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagct

SEQ ID NO: 105553 - DNA, 729 bp, Homo sapiens
  Payload ID: 695
  Gene Symbol: ADGRL1
  Gene Name: adhesion G protein-coupled receptor L1
  ENST ID: ENST00000593005
  CDS Start-End: 1-729
gatccctcaagacctcagccatgcgaagcaacacccgctactacacagggacccagagccgaattcggaggatgtggaatgacactgtgaggaaacagacggagtcctccttcatggcgggtgacatcaacagcacccccaccctgaaccgaggtaccatggggaaccacctgctgaccaaccccgtgctgcagccccgtgggggcaccagtccctacaacaccctcatcgccgagtcagtgggcttcaatccctcctcgccccctgtcttcaactccccagagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcct

SEQ ID NO: 105554 - DNA, 675 bp, Homo sapiens
  Payload ID: 695
  Gene Symbol: ADGRL1
  Gene Name: adhesion G protein-coupled receptor L1
  ENST ID: ENST00000589616
  CDS Start-End: 1-675
tccgccgggcacccctcaccacgcacccagtgggtgccatcaaccagctgggacctgatctgcctccagccacagccccagtccccagcacccggcggcccccagccccgaatctacacgtgtcccctgagctcttctgcgagccccgagaggtacggcgggtccagtggccggccacccagcagggcatgctggtggagaggccctgccccaaggggactcgagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaagatgcacaagcgagagagaacttgtaaggattatatcaaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtggtcctggaggtcacagtcctgaacacagagggccaggtgcag

SEQ ID NO: 105555 - DNA, 5479 bp, Homo sapiens
  Payload ID: 696
  Gene Symbol: ADGRL2
  Gene Name: adhesion G protein-coupled receptor L2
  Uniprot ID: O95490
  ENST ID: ENST00000319517
  CDS Start-End: 217-4428
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattctttttt

SEQ ID NO: 105556 - DNA, 4674 bp, Homo sapiens
  Payload ID: 696
  Gene Symbol: ADGRL2
  Gene Name: adhesion G protein-coupled receptor L2
  Uniprot ID: O95490
  ENST ID: ENST00000359929
  CDS Start-End: 182-4393
aactgtgttctatgtggatccagcattacaactgataagggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtga

SEQ ID NO: 105557 - DNA, 5382 bp, Homo sapiens
  Payload ID: 696
  Gene Symbol: ADGRL2
  Gene Name: adhesion G protein-coupled receptor L2
  Uniprot ID: O95490
  ENST ID: ENST00000370713
  CDS Start-End: 217-3588
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattctttttt

SEQ ID NO: 105558 - DNA, 5585 bp, Homo sapiens
  Payload ID: 696
  Gene Symbol: ADGRL2
  Gene Name: adhesion G protein-coupled receptor L2
  Uniprot ID: O95490
  ENST ID: ENST00000370715
  CDS Start-End: 217-3750
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggactgacatcacatggtctgagagcccatcttcaagatttatatcatttagagctactcttaggccagatagcctgagcagacagacatgatgtgagttgtccaaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattctttttt

SEQ ID NO: 105559 - DNA, 5873 bp, Homo sapiens
  Payload ID: 696
  Gene Symbol: ADGRL2
  Gene Name: adhesion G protein-coupled receptor L2
  Uniprot ID: O95490
  ENST ID: ENST00000370717
  CDS Start-End: 217-4596
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 105560 - DNA, 5023 bp, Homo sapiens
  Payload ID: 696
  Gene Symbol: ADGRL2
  Gene Name: adhesion G protein-coupled receptor L2
  ENST ID: ENST00000370721
  CDS Start-End: 646-4800
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatggagcaaaaagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 105561 - DNA, 5254 bp, Homo sapiens
  Payload ID: 696
  Gene Symbol: ADGRL2
  Gene Name: adhesion G protein-coupled receptor L2
  Uniprot ID: O95490
  ENST ID: ENST00000370723
  CDS Start-End: 646-5031
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 105562 - DNA, 5293 bp, Homo sapiens
  Payload ID: 696
  Gene Symbol: ADGRL2
  Gene Name: adhesion G protein-coupled receptor L2
  Uniprot ID: O95490
  ENST ID: ENST00000370725
  CDS Start-End: 646-5070
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 105563 - DNA, 5164 bp, Homo sapiens
  Payload ID: 696
  Gene Symbol: ADGRL2
  Gene Name: adhesion G protein-coupled receptor L2
  ENST ID: ENST00000370727
  CDS Start-End: 646-4941
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 105564 - DNA, 6302 bp, Homo sapiens
  Payload ID: 696
  Gene Symbol: ADGRL2
  Gene Name: adhesion G protein-coupled receptor L2
  Uniprot ID: O95490
  ENST ID: ENST00000370728
  CDS Start-End: 646-5025
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 105565 - DNA, 6173 bp, Homo sapiens
  Payload ID: 696
  Gene Symbol: ADGRL2
  Gene Name: adhesion G protein-coupled receptor L2
  Uniprot ID: O95490
  ENST ID: ENST00000370730
  CDS Start-End: 646-4896
ctctttctctctccctctcttgcgctgtccctcattcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaagctctaaacttcacaaatggttctgaagagtatggagcctacgtagattcataagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 105566 - DNA, 2692 bp, Homo sapiens
  Payload ID: 696
  Gene Symbol: ADGRL2
  Gene Name: adhesion G protein-coupled receptor L2
  ENST ID: ENST00000402328
  CDS Start-End: 1-1414
gatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccagcaacctacagagagacaagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 105567 - DNA, 4278 bp, Homo sapiens
  Payload ID: 696
  Gene Symbol: ADGRL2
  Gene Name: adhesion G protein-coupled receptor L2
  ENST ID: ENST00000449420
  CDS Start-End: 1-4055
tttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctggctatgaagataataagccatttatcaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaa

SEQ ID NO: 105568 - DNA, 5789 bp, Homo sapiens
  Payload ID: 696
  Gene Symbol: ADGRL2
  Gene Name: adhesion G protein-coupled receptor L2
  ENST ID: ENST00000627151
  CDS Start-End: 217-4512
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctgggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 105569 - DNA, 4962 bp, Homo sapiens
  Payload ID: 697
  Gene Symbol: ADGRL3
  Gene Name: adhesion G protein-coupled receptor L3
  ENST ID: ENST00000506720
  CDS Start-End: 1-4743
atgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 105570 - DNA, 4843 bp, Homo sapiens
  Payload ID: 697
  Gene Symbol: ADGRL3
  Gene Name: adhesion G protein-coupled receptor L3
  ENST ID: ENST00000507625
  CDS Start-End: 107-4693
aaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagactttttttttttta

SEQ ID NO: 105571 - DNA, 4982 bp, Homo sapiens
  Payload ID: 697
  Gene Symbol: ADGRL3
  Gene Name: adhesion G protein-coupled receptor L3
  ENST ID: ENST00000507164
  CDS Start-End: 130-4158
tctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgt

SEQ ID NO: 105572 - DNA, 4758 bp, Homo sapiens
  Payload ID: 697
  Gene Symbol: ADGRL3
  Gene Name: adhesion G protein-coupled receptor L3
  ENST ID: ENST00000508946
  CDS Start-End: 1-4539
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 105573 - DNA, 6297 bp, Homo sapiens
  Payload ID: 697
  Gene Symbol: ADGRL3
  Gene Name: adhesion G protein-coupled receptor L3
  Uniprot ID: Q9HAR2
  ENST ID: ENST00000514591
  CDS Start-End: 330-4739
agaaagcggacaggagggcgacttttctccgtcaggctggaactggtgccgctggaggcgggagcgggctggaggacggacagggtctggaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactat

SEQ ID NO: 105574 - DNA, 12636 bp, Homo sapiens
  Payload ID: 697
  Gene Symbol: ADGRL3
  Gene Name: adhesion G protein-coupled receptor L3
  Uniprot ID: Q9HAR2
  ENST ID: ENST00000512091
  CDS Start-End: 748-4470
ttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaagaaatgtttaatttggtaaattggaggaaaaaaacatggatttttagcaattgaagagcaaattaaggtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactatatgattaatcagtctttttatttttctcgcctttctttctttctgttttcaatacataaactttgctaatcctctgtggcccaaatgagccatgcaaaagaaatcaatctgcctagatgaataagctaagcacaaaatcatacaggtttgcagacaaagtaaaccagaaaaatggaatgggcatgtttattttggatgaaatcagatgcataacttaatgttgagcaggttaacatatatgttactatttgcttatctataaaccagctgcagtcactatgcttacctttaaaaccagattcaatcagagatataaatatgaaatttgggggctgggtgagtcatattttttcctcctttgtacattgcattttgatgttagaaattcaaattccctcaatttgctaaaagctgcaaagagaatattcattttataaagatataataagacttttattgtgtttttttcttattctatatatgagggaaatcggaaaagataaagaagttctttcaaagaaactttctagatctctcattactgcagatcctttatagcagtgtccaagtacagatcccctgttagggcaaagctaaaaggaacctgccaaattataatttctcctgtagtgtgttttatctcggggtttcctttttcaaaaatctaaacactatccatctataaatgactatcttaaatcaagtttagagaatggccaataatctgtatatagtttataaatacatgacaaaaaaatttctgctgagccagagtgcatcataaccttcacatcacctcaaaatattttatgtctcattcttttttagtgaattggcatgaatattttttaagtctacagattttatgttagaggagaatcacaagcgttaatgataattaggttttctcacaccacactatggcaatattagcacgtccaaggcttttaacccacccgatacatagaatacatttggcaataaaagaatcctttttagatgtgtttatggtaacttcagaaacacaaatgtggtctgtggattatgagcacttatgcttgttttgtcaaacagtaacctacatgaaagcaactctatcagtaagaagctggtttcacagaaaaatggggaaactacctcaattcagcttgctgattttctgacattgctacctccctgcccattatttttgtgtttctatatggaaatttgaagcaggtagcttctcaagctctacatagaccaaactgaagaaagatcacttgaatacacaaactggtgcagaagaacattcagcatataaagttactaccaagctcttgcatcaagaaaaaagagtgagatttttgaactctatacatcataaatggcatgctttcagagagacttaagatcccaaagattataacagagagaaatttcccctgcaagtattatgtaaccgtaattaaaaaaaatggataaaggagctaattttacatacatttcaatagaaatttgcatatatctaacatattcattttgtcctgtttacactagcaagggttgaattcctgaacttgaatctttttcttcatatacattttcttatagagctattgatgaattaattaatgattttttaattgttcttttttctaccaccttttgtgactcaattttttaagatcctgagacatttatgacctgcttatctgtatatttttatgtgttcatctgaatttccagtaagaagtaaatttccgtcaaacagatgtagtataccgctataatacagcttatttagccagctagaagtaaaacttatgccaccgaaacaaacaaatgattactttcttgtcaaataatatttttgtcacatttttagacttggttgtttttcctctttgaaatctagttcacatgacactttatcagggacactagctaatggacctcatgtttagttaattctgaaactgatggattgttgcacagcctctgctcctaactgataaatatttgcggcaaagtccaaattttgtgaaggagaaattggttggaattaaattttatgggcgtcccttcttgtttccactatattataattaaacacactgaagttgaataataaattactgtgctaaaataattgtaataacaaaaatgaactgacagaacaattatcttgaagtaacaataatcaggaaaatatctaacaaaaagcacgtaagggaaatatccttaacttcctgtaaaaaaaattcacattgactctaaattaagatgtagtttatcatctgtattttaaaatatccatcataactaaaaatgttgacatattaaggaaaggatctttaagatctaggtttaagattcttattagtattaacttaattggtatgacaaaacttttcataatagatataagcatataagggaattagtaacatttataaaggacccacatatttaattttaggcattgtcttcagcttccctggacccccaacacatgttgaaatgttattgactagcttgctttttttaaggaatgacattaaaaatttcgactgactttctacattactgtaaagatcaaaagggagaggaaaaatagtttacaagttttctaaagatcaactccagactaatctatatcatcccctaataatgaaaaaacaattagtttttagaagttgtctatcagtactgtaccgaagtgctactgcttggatttttttgttgtggttttaaagagatggggtcttgctctgtcacaaagactgaagggcagtggcacaatcccagctcactgcagcctcagactcttgggctcaagtgatcctgctgtctcagccttctgcgtagccatgatcacaggtttgagccacagcacttggcctgtgatgtattgcagagggaaaaaaaccaacactacagaagtataatgcatgtcaattcagatttagagagtgtaaaaaacaaaaacccaaagtccaactatttagttttgagcaaatctgaagatattggcatgaatatcctttcttctctaagaaaatttttgagataacaatatatatgaagttcccagtacattgtagaccaaggtgttaaaatttaattagttcatttttagtaattcataattttaacttaccacataaacaattactatgcatttctaagtaacgttttcaatatagcttatattagatttctgcacatcattaaattacgaagatggcacaaaagcaaagcagcaacattgcacaatagcttatggaagcatttttgtgcgaatggattttacataagaagcttttctgagctcataaaatatattcaatggatcccaacattaaatttaactttgcaatcagcaaatatgttctttataacatcttaaaaatattaaacaattaaattttcatttgtaggctagcagaacttaaatgtgttggtagttgcttctttcctgattaggccataagaagaaactttcctatttactaattaacactgattacactctctttggtttaaaagggaaactttcacctgtacacatacacactctgattccatttatttacagcctgcagaagaagtagcttgtttacgatatttaaaactttgtgatttctgcaataaaacaggtagttaatatagtttcgcataatctcattgaaagatattgctattccttctttatttaaaaaaaaatttaaaagtcagcacttctttcacatctagcacctataagttactattcaaatgtcttgatttcagctaagttttgatgtttctttttctcttaatagtatgtcaaaagcattgttctcatttgataatttgtgtcccgttacagtatttcaaaggtaaatgcaaactaatttttaggaaggcttgtgaaagaactttgatttatgtgaagaaatcaagaaagactatacatgaacaaatctctattgggataaacaagtctcttcaaccacaatatgaacaacggaagagcagaaaccaaacaagttagcaaacttatggtaaggtgacaggacctaaactagagttacagagaaaagttttccaggaaagaataatgaagtcatttgtagtgataaaaatcttatacactacaccaaatgttacagatgtattccgaaaagtaaaatgggagtttcctatattctgatttcattctgctaattccacgggaaacattaaatactttaaacactcttgagatatttcgtatctagctataccttgtctcaaggaaacatcaatattttataaatgtttcttaaatataagtattttgtctgaattcatcttcactctctaatctgctggctctattgaacaccaacagagttaatgcttttagtagctttgtaccttttaaagctctattatgaatctttctaatacatatgaaattaatattatattagaattatgtacattatacaaaataattcataaccaagaaatattcatactatagaataatttattattatatatatgaatattacattgagactgaacaaataaccactctgctccaaatattactctcaagttctctgcctttaattattatagtcaattcataaaattctacatacagttgtacatggtgggttatcaaagtactccataatccaaatgcatctaaaagtattccaaatgcgcctttcattctagaatactaaaggaaagcgtttgaaagaagaggaaagtaaagcagacttctaactatttaatttaaacattgccattcagattgaataatttttaaatgatgatgctccactctttgatctacagacaaggttacaaaagatttacaattagtccaaaatcagaggattttaaatcttaaaggagttaagtttgtctcaatgatccaagactacaaaatttcttgctacattggcaaggaaatatgtttaaagccgagaactaaaatagctttttaaaatttaaaaattcctctgtttcttctgaatgtaaaacaggcaaaatgatcctgacttcaaaatgaaatatattgattgctctcaaaagatgtttgacaaagttaagtcagtatcttcaatgctttaacagtaggtagaggtctttggggttggaactcaggatacagtgactaggacagagtgcattcttaggctaattagtgcctagtcctctggagtattttttaatgccctgaatttcaagttgtcaaactggtttacatattgaatgacattttgaatcaataaaaatgagaaaaaaacatttaaatttggttttcatgactcatttgagaataaagatttccttcatcaccctaagtaataaaagctgatatgtcttgaaacaactatagacaatcagaatgtgttcatttataaagtatcactggtttgtatattttaatgctgacctttgcctgtgaactagaaaatcaagatttgtagagtcaggttgatttgccttcatttaattcctgcaaatgcattggaagtggatggataacttggaactttttccatactgttttccccctcaccaagcattaaatctaattcaaaatatgtctttctaaaaaacaatagtttatttttaaaactaacaactaattgtgttattccttgttgataagaaagtcactttttagaaacaagaatatagctattgtggctttggtcgcttaggattctcatatatttacacatggcattattcttttcatatacacctaccagatttcaagctattggatatttcccttgtacaacctttacatcctttttttttccttaaatgctctgtacaatcacatgtaaagtcatgagctacaaacctcaataaaaatatcagtaaacaagaa

SEQ ID NO: 105575 - DNA, 4816 bp, Homo sapiens
  Payload ID: 697
  Gene Symbol: ADGRL3
  Gene Name: adhesion G protein-coupled receptor L3
  ENST ID: ENST00000504896
  CDS Start-End: 96-3947
tcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaact

SEQ ID NO: 105576 - DNA, 5069 bp, Homo sapiens
  Payload ID: 697
  Gene Symbol: ADGRL3
  Gene Name: adhesion G protein-coupled receptor L3
  ENST ID: ENST00000509896
  CDS Start-End: 174-4100
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 105577 - DNA, 5009 bp, Homo sapiens
  Payload ID: 697
  Gene Symbol: ADGRL3
  Gene Name: adhesion G protein-coupled receptor L3
  ENST ID: ENST00000508693
  CDS Start-End: 130-4185
tctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgt

SEQ ID NO: 105578 - DNA, 4838 bp, Homo sapiens
  Payload ID: 697
  Gene Symbol: ADGRL3
  Gene Name: adhesion G protein-coupled receptor L3
  ENST ID: ENST00000506700
  CDS Start-End: 174-3869
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 105579 - DNA, 4731 bp, Homo sapiens
  Payload ID: 697
  Gene Symbol: ADGRL3
  Gene Name: adhesion G protein-coupled receptor L3
  ENST ID: ENST00000514996
  CDS Start-End: 1-4512
atgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 105580 - DNA, 4284 bp, Homo sapiens
  Payload ID: 697
  Gene Symbol: ADGRL3
  Gene Name: adhesion G protein-coupled receptor L3
  ENST ID: ENST00000502815
  CDS Start-End: 1-2755
ttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagattt

SEQ ID NO: 105581 - DNA, 5042 bp, Homo sapiens
  Payload ID: 697
  Gene Symbol: ADGRL3
  Gene Name: adhesion G protein-coupled receptor L3
  ENST ID: ENST00000511324
  CDS Start-End: 174-4073
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttcccc

SEQ ID NO: 105582 - DNA, 4789 bp, Homo sapiens
  Payload ID: 697
  Gene Symbol: ADGRL3
  Gene Name: adhesion G protein-coupled receptor L3
  ENST ID: ENST00000514157
  CDS Start-End: 96-3920
tcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaact

SEQ ID NO: 105583 - DNA, 4935 bp, Homo sapiens
  Payload ID: 697
  Gene Symbol: ADGRL3
  Gene Name: adhesion G protein-coupled receptor L3
  ENST ID: ENST00000506746
  CDS Start-End: 1-4716
atgtggccatcgcagctactaattttcatgatgctcttagctccaataattcatggtggcaagcacagtgaacgacatcctgcccttgctgctccattgcgacacgctgagcgcagcccaggaggcgctcttccacccagacatctgcttcagcagccagctgcagagcgcaccgctgctcatcgtggacaagggccccgtggagctaccagaggagttcgcggtccaggtgcccaaggagcacagattgcagcgcaagctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagaggagccatggctaatcatcttataagcaatgctctgcttcgtccgcatggtactaacaatccctataatacattgcttggggaaccggcggtctgtaacaacccttctgtcagcatgtacaacgcacaagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttctt

SEQ ID NO: 105584 - DNA, 5567 bp, Homo sapiens
  Payload ID: 697
  Gene Symbol: ADGRL3
  Gene Name: adhesion G protein-coupled receptor L3
  ENST ID: ENST00000545650
  CDS Start-End: 1-4038
ccaatagaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagaggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagattt

SEQ ID NO: 105585 - DNA, 3527 bp, Homo sapiens
  Payload ID: 698
  Gene Symbol: ADGRL4
  Gene Name: adhesion G protein-coupled receptor L4
  Uniprot ID: Q9HBW9
  ENST ID: ENST00000370742
  CDS Start-End: 65-2137
cgggtccacagccgcactcactccgccgcgctctccgccaccgccaccactgcggccaccgccaatgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttgtatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaaaaaaaaggtttacctccacaaattgaaaaaaaaaaagtgaaaaaaatctgtttctaaggttagactgagatatatactatttccttacttatttcacagattgtgactttggatagttaatcagtaaaatataaatgtgtcaagatataatattgtttatacctatcaatgtaaaaacagtgtaataaagctgaagtattctattacctttcagtgaagtgaaagttatactatctcattagtatatttgaatcctttattatttttaattttataaatatcacagttcacattgcaatattccctttaatttactatttttaaaggggtattgtaaatatgaaagtatttataaagtgaattgctattttttctgttcagaaaagtacacacttaaaattgttattgttaacaatgtgtaaacacatttaaaattgttattgttaacaaagaaatcatggagaactgtagaggttttcacagtggatccattttctgacagttttctactatctattaaatcatatctgcttaaatatatagcttctatctgtctttaaatcttctcattaaaatgtataagcagtgattttgatctcaaaaataggtaatttttctttgccgacctgtaaaagtgtgccaatacactaaatttgtgattttaaattaattcctccagctgttgaaatgaagtctgccaaatcttgctctaacaaataaaatgttatctaaatgaa

SEQ ID NO: 105586 - DNA, 501 bp, Homo sapiens
  Payload ID: 698
  Gene Symbol: ADGRL4
  Gene Name: adhesion G protein-coupled receptor L4
  ENST ID: ENST00000401034
  CDS Start-End: 1-450
gtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaagctgttgaaatgaagtctgccaaatcttgctctaacaaataaaatgttatctaaatgaa

SEQ ID NO: 105587 - DNA, 19338 bp, Homo sapiens
  Payload ID: 699
  Gene Symbol: ADGRV1
  Gene Name: adhesion G protein-coupled receptor V1
  Uniprot ID: Q8WXG9
  ENST ID: ENST00000405460
  CDS Start-End: 97-19017
agtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctatttgg

SEQ ID NO: 105588 - DNA, 6503 bp, Homo sapiens
  Payload ID: 699
  Gene Symbol: ADGRV1
  Gene Name: adhesion G protein-coupled receptor V1
  Uniprot ID: Q8WXG9
  ENST ID: ENST00000425867
  CDS Start-End: 285-6188
attactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatct

SEQ ID NO: 105589 - DNA, 5211 bp, Homo sapiens
  Payload ID: 699
  Gene Symbol: ADGRV1
  Gene Name: adhesion G protein-coupled receptor V1
  ENST ID: ENST00000509621
  CDS Start-End: 1-4826
ccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctcaaaaaaaaaaaaaaaaaaa

SEQ ID NO: 105590 - DNA, 5046 bp, Homo sapiens
  Payload ID: 699
  Gene Symbol: ADGRV1
  Gene Name: adhesion G protein-coupled receptor V1
  ENST ID: ENST00000504142
  CDS Start-End: 1-3166
aagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtgagggtcatcatcacaactaggacactgaaatttgcagtttctaaaatttttcattaaaatttagatttttaaaaaagtgctaacatgtatttgaaaactctacttatgcattggtttaatttctttaatcaaaactatgtgcctaccaagataatgagaaattctgtcctgagtgttacagaaatgaatcagagaattttgcccttaaagaacctggaataaaccctagcagagagatgtgtgatatatcacaatgacaccctgtaggaagacagaaaaaaatatgaaagaggaatgtttgtccttctgtgggtagtaggagagatggggagtgatattcctgcagaggaatgaacaaaggaatagaaatgtgaaacagcgtgttgcacctggggaactgctgctagttcagtattgctgaaggtagagggtggtgggcgtgaggttgaaaagaaagcaggagagaagaatcacagtgaaaagtgattatagggttcatactatcagcaggtaacttggtgaattctacagagtgctttgaagagatattctttgttgtctttaaactagatcatatgctgattcctcaagaagcacatttgtgtgtgtgtgcacacaaatactggttatatgcattatagtcaccattccctctcagcccctccatcttatgattttattcttttttatatttcgtgaaagatagagtagagcttatatggctatagcttaatagagtattttcctctgaacctcttacattagttatttggttctattttttttcccagagggggaaaaaaagataggcaaaggaaaatgcacgtatctaccaatttcaatcccatggattttggttacaagcactttgtggtattatccactttttggctgtgtgaatacctacaagtatctgttagccttgattcttttggtgatggtagtggtggtggaatgagaatggaaacgattgggggaagtgggagctggtgttttttcctctgacttactgcagaggaacttgttatttttgtactttgtaatttggaaagataatttttaaactatatgtaaagttattgaactgtagtgccctttatattataaaaatataaaagtatgcatattgtaagtgtacagataagtgaaatttttaaaacttaaattcatcagtttcagcactcatgtgatcagcccccagaccaagaaacagcattccagaagccccctttgactcctccagttgctaactcaccaccctgcctactgactattggcatttttaagagcttaagattcacttttcctatttttaaatttatataaatagaactgaacagtatgtacacttgagtgtccagcttcttttgctcagtattgtttgtgaagttcatccatatttttgcctgctgtagatatttcatgctcattaccatatagaattatcttatgtaactgtaacacaatttatttattagtgctactttcaatttctgttttggttgttttctgttctgcctactacatatagtacttctatggatactcttatacatgttttttgatgaacatatgcctgccatatgcatttctgttgagcacattcctggggatggaattgctgaatgacagtgtgtgcaaatattcggttttagtagataatgcctatcctttttccaaaacagttgaacctaattatactctcacctctagtgtatgagagttccacttaattaatgcttagcttcttccatctttacttttggtttgtagtggcatctcacagtatcataaaaggtgtatttaaaaaaaaataatgctgtgttcaatatagaaaaattgtaaagtacacatatacaacaaaaatagaaatcatttacaataaaaatcatttacaatc

SEQ ID NO: 105591 - DNA, 582 bp, Homo sapiens
  Payload ID: 699
  Gene Symbol: ADGRV1
  Gene Name: adhesion G protein-coupled receptor V1
  ENST ID: ENST00000508842
  CDS Start-End: 139-582
accacacctgtggccgaggctcagcgcctcccgtgaggacgcagctggggctcaaccccgccctcctggaccgggctaccctcacctcctgccaccatctttacctgtccccgttagcagggagcactctgcgagaagatggccaaaaggtccgccgccgccgctgtcccggggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagcttccctcaatcgcagtgagtgagcccaagggcagaaatgagtctatgcctcttactctcatcagggaaaaggga

SEQ ID NO: 105592 - DNA, 2229 bp, Homo sapiens
  Payload ID: 700
  Gene Symbol: AMIGO1
  Gene Name: adhesion molecule with Ig-like domain 1
  Uniprot ID: Q86WK6
  ENST ID: ENST00000369862
  CDS Start-End: 385-1866
gcgcgcgcggtgctcgctgcccccacgccgctccctccgctgggatcgctgcgcctccggctccccgcaccgatccgcgccaggcctgcggacctggaggcagcgaccgcggtcggtgggctccggcgggctcagcggtcgaggcggtggcagggtgagcggagcggggccccgcaagtccccgggaggcgacggtgccgggcgcgggcccctgcgtaaggtgggcgcagtgacaggccggccggtgaggcgccgccgggagaggccgcgacggagctcccagaccggccatgggctgagacacgtcctcgccgagcagaacatgcccgggtgacctcctcccagatcttccttgtggccttcctcgcccactccagtgacactatgcacccccaccgtgacccgagaggcctctggctcctgctgccgtccttgtccctgctgctttttgaggtggccagagctggccgagccgtggttagctgtcctgccgcctgcttgtgcgccagcaacatcctcagctgctccaagcagcagctgcccaatgtgccccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagctacccaaactaacgctcctggatctctcttctaacaagctgaagaacttgccattgcctgacctgcagaagctgccggcctggatcaagaatgggctgtacctacataacaaccccctgaactgcgactgtgagctctaccagctgttttcacactggcagtatcggcagctgagctccgtgatggactttcaagaggatctgtactgcatgaactccaagaagctgcacaatgtcttcaacctgagtttcctcaactgtggcgagtacaaggagcgtgcctgggaggcccacctgggtgacaccttgatcatcaagtgtgacaccaagcagcaagggatgaccaaggtgtgggtgacaccaagtaatgaacgggtgctagatgaggtgaccaatggcacagtgagtgtgtctaaggatggcagtcttcttttccagcaggtgcaggtcgaggacggtggtgtgtatacctgctatgccatgggagagactttcaatgagacactgtctgtggaattgaaagtgcacaatttcaccttgcacggacaccatgacaccctcaacacagcctataccaccctagtgggctgtatccttagtgtggtcctggtcctcatatacctatacctcaccccttgccgctgctggtgccggggtgtagagaagccttccagccatcaaggagacagcctcagctcttccatgcttagtaccacacccaaccatgatcctatggctggtggggacaaagatgatggttttgaccggcgggtggctttcctggaacctgctggacctgggcagggtcaaaacggcaagctcaagccaggcaacaccctgccagtgcctgaggccacaggcaagggccaacggaggatgtcggatccagaatcagtcagctcggtcttctctgatacgcccattgtggtgtgagcaggatgggttggtggggagattctgccccaggagaggtaatgcacccctgaaggatatgaggggatggaagagagggctggctgcccaagggaatggattcctcctgacctcaagggaattggtcccaggtacaacagagagcaagaccccaaacagggcgtggctgccacgattttcaaatgggggtatattaatcctcaggcaaatgctacacccgtacccaaagccctgccaattctcagtgtggtagaggaagagaagcatgtctgagttggatgggaatgaggaaggagtgaggggaagaacagattccctaaactttcatgaggtcatccctagctccttaagagaaaaacattt

SEQ ID NO: 105593 - DNA, 5088 bp, Homo sapiens
  Payload ID: 700
  Gene Symbol: AMIGO1
  Gene Name: adhesion molecule with Ig-like domain 1
  Uniprot ID: Q86WK6
  ENST ID: ENST00000369864
  CDS Start-End: 351-1832
ccggctccccgcaccgatccgcgccaggcctgcggacctggaggcagcgaccgcggtcggtgggctccggcgggctcagcggtcgaggcggtggcagggtgagcggagcggggccccgcaagtccccgggaggcgacggtgccgggcgcgggcccctgcgtaaggtgggcgcagtgacaggccggccggtgaggcgccgccgggagaggccgcgacggagctcccagaccggccatgggctgagacacgtcctcgccgagcagtgacccttccgtaccccaccagaacatgcccgggtgacctcctcccagatcttccttgtggccttcctcgcccactccagtgacactatgcacccccaccgtgacccgagaggcctctggctcctgctgccgtccttgtccctgctgctttttgaggtggccagagctggccgagccgtggttagctgtcctgccgcctgcttgtgcgccagcaacatcctcagctgctccaagcagcagctgcccaatgtgccccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagctacccaaactaacgctcctggatctctcttctaacaagctgaagaacttgccattgcctgacctgcagaagctgccggcctggatcaagaatgggctgtacctacataacaaccccctgaactgcgactgtgagctctaccagctgttttcacactggcagtatcggcagctgagctccgtgatggactttcaagaggatctgtactgcatgaactccaagaagctgcacaatgtcttcaacctgagtttcctcaactgtggcgagtacaaggagcgtgcctgggaggcccacctgggtgacaccttgatcatcaagtgtgacaccaagcagcaagggatgaccaaggtgtgggtgacaccaagtaatgaacgggtgctagatgaggtgaccaatggcacagtgagtgtgtctaaggatggcagtcttcttttccagcaggtgcaggtcgaggacggtggtgtgtatacctgctatgccatgggagagactttcaatgagacactgtctgtggaattgaaagtgcacaatttcaccttgcacggacaccatgacaccctcaacacagcctataccaccctagtgggctgtatccttagtgtggtcctggtcctcatatacctatacctcaccccttgccgctgctggtgccggggtgtagagaagccttccagccatcaaggagacagcctcagctcttccatgcttagtaccacacccaaccatgatcctatggctggtggggacaaagatgatggttttgaccggcgggtggctttcctggaacctgctggacctgggcagggtcaaaacggcaagctcaagccaggcaacaccctgccagtgcctgaggccacaggcaagggccaacggaggatgtcggatccagaatcagtcagctcggtcttctctgatacgcccattgtggtgtgagcaggatgggttggtggggagattctgccccaggagaggtaatgcacccctgaaggatatgaggggatggaagagagggctggctgcccaagggaatggattcctcctgacctcaagggaattggtcccaggtacaacagagagcaagaccccaaacagggcgtggctgccacgattttcaaatgggggtatattaatcctcaggcaaatgctacacccgtacccaaagccctgccaattctcagtgtggtagaggaagagaagcatgtctgagttggatgggaatgaggaaggagtgaggggaagaacagattccctaaactttcatgaggtcatccctagctccttaagagaaaaacatttagaaaaaaaaattttttctatctctgcccacccacacctgtgatgttgtgtgtgttgggggagcttccacaggagccacactggggaaaagctgtagtatcttctttgtttagcaagtcaaacttcacagctggggaagttgaaaacctttggaaaatgagtcaggaaaaggctgagacctcaatcggtaacaattccccaaagctgttgtaagactttgcattaaagccttcctttttcctgatgtgccctgggtggatggatctttgcaggagcctggcctgctgccttttagttacaacagcaatgtgggatgtggtatctgtgccttgtcctgggaccaatggcacagagggttatagcatgaactgaagggtccatgtcacagcataggtgccagcacgaaacttgtagatggggggtgaattccagataggctaattccctggttggtgaaacccttggttagtatttgattcccagcatctgtgtgtcaggccagagtgggggctgctgaaggcagagcttttatggatgcctgccacagacgtggtacatgggcccacttcacgatagaaggatgaaggtaaatcagcctctattatgtagcatccagctggacctagctgattctcaatgtatgccatctcttcatccagtctccttatcaagctcaggtgggattctgaattttccctaatatgctgctctgtaaagggaggagtccaagaaagcctggccccagctggcttagagtaggcttggcgatagtgaaaatccagtatatatctcctctgtgtggacaaggttgccttgctcctctcagagataccacctctgctgcaaagtcaaagcatggggttttgacatcagaagggttggaattgggtggtctctaccccagaatggcaatttggagtgcagcttcaagttctgccctctccacagattccaggcaatcctgaagcagagataatcagtagtactaaactttcagaaggggagttctgccaccccattcctccatcgagaggtctttgcagttgtggttgtgaggccagaggaacttaagaagaatgagctcaacattccattccatccaaggttgcagaatactttgagtatggagatgaccgatccctttaacctttccctttgactacactgcatgccctgtgagtggctgctctgagctttggcgggggatgagcagggtgaaggtgaaaatgttctctgatgttggtttttcttagggtctcttctctcccacgtttctagtccattggaagttctccagatcctctagatttctgacctctttttacattctaagaggtgtcatttacctgtgggtgaggggcttggagggcctgactattaagcttcctattatgattggggaaggggactcaacatcttccccttgtctggtcctgggaactcaagactgctgtccatcctttattagtaacctagttttgttgagagagaggtgcagcatttccctcaagtacctgcatgctcataggtatgcatgcttataggtatgcatgcacaccagcaccttgacttccaccaggacagtgaatctgtagtccccattaatgatactctcagaatggtctccaccaatgtgcacaacttcatgcacacaattgtattcctctttaggagagacagtgaccatgccaggctcttcaaatacacactcctgtattttcatttctgaactccctgaagcttcacccacatctccatggcactgaatcacttttctgcccaggctggagttagaagaaccatgggttgaaggccttgggagaagaggtggtaaggagctacctggttctttggactcctcagaaacctcccgtgaagactatatatatgagcaatatatgagcaattaagatagaactaggtcattgaaggactcagaaggaaactggcaaggggctaagtagctgtgagctgctcttcctgttaactgtcctcaggagagaaaagttgtcttgatttattccagagactcctgagaattttgttactggagctataggaactaggactccctcctcagactcatcaggaaatctgggaaaatctcatctccatgctgcagtctccccgcttggcaccatctagggctctgaagatctttaaagtgagcgttaaatgaagcaggccttctggggcatcgtgatggagctcctgaggactgggagggccgttttcttcataattcctacccagtttagggaatgagaaaaggccctgtggctcttaagtctcctgactatatccactagtttggccttgagtttgagacacctggtagatgtacctggctgccctaccaagagatttgatttgtttcttcccgtggtttcaggtgatagaacccaaaggtagctttttaattggagaattgaataatcagcatatgtaagcgcactagaaccctgtgttgaaaactgccaggtgtgggtataagaaaaggccgagagatcaccacctcctcttaccctaccccacacccataaaccagacatgtctcccaggaagcaggtgtccctggagacagaggatgacagggctctacaatctgtgtaattattattattattattattttgtatttatggggcccaagaaaggggccaggagagggtacaccccagctggggagagcaaagcagatggatccagttttctgtgtgttcttacctctgtacttcctcgtagctctgctgacaaagcaagcaggcctcccgtgtccaagaccccattcctcccacttgtgtacacctaggctggcaaatcttggagcctctgggctctgaaaactagacaatgatcattaaacctggcttgagtctctgttctggcacaa

SEQ ID NO: 105594 - DNA, 3763 bp, Homo sapiens
  Payload ID: 701
  Gene Symbol: AMIGO2
  Gene Name: adhesion molecule with Ig-like domain 2
  Uniprot ID: Q86SJ2
  ENST ID: ENST00000266581
  CDS Start-End: 468-2036
gggtcctgcagcctcccgagtgcggagaggcggggccgcccgctgccgcccggctgcctgcgccccctcccgcggccccggctctgggagcggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccatagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaaagttgatttttttaaagggggaggggaaggctttaatgtgttctagatcaatttataccttccgtatgacgttttactctgatatcattgtgcactttagccagatccagaaaacactcaaatttattttgcaacaagtgagagcccaggagacctccttattatcctgtctctgctttgaggcaatcaagtaccctctctgaacctaggttccctcatctgtaaaacaaaggtttcagaccagatggtgtttaaggtttctccccatactggaatgaatgatttcttggtggtattagcatcatcacagacctatacttgctttctgaaactctaccacatactgaaggaatacaggaatgggattaagatgactagcatagcagtgtacagcttgaagagatgttccacatcatcactccagctccttctcttttctcagggacaaatgaggcccagagagaatacgacctgtgtaaggtcaaacagtggcagggaaagaaggagagctggggtttagcattctccctggtgaagattggaggtccaaagaaatgactcctttttaagggatgggcataaaaaagtgatcaaaacattgcaaaggagaatcaaagattgattgtcctggggctaagaaagaagataatttttaaagaatgggagtgggcaacagtgaaaaatattgcagataagtagataaggatagaagatcaaccactgactggtagta

SEQ ID NO: 105595 - DNA, 3058 bp, Homo sapiens
  Payload ID: 701
  Gene Symbol: AMIGO2
  Gene Name: adhesion molecule with Ig-like domain 2
  Uniprot ID: Q86SJ2
  ENST ID: ENST00000429635
  CDS Start-End: 656-2224
cgagctgctgcccgcaggaggcaggacgcgcaggggtgggaccggcgccccagcccgtctcccggccccgggcgcgcgggaaccccgggtcctgcagcctcccgagtgcggagaggcggggccgcccgctgccgcccggctgcctgcgccccctcccgcggccccggctctgggagcggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgactaacccaggaaagaggaaaaaatacatttaacagtgaagaggcaacacagagctccctattgtgaaataaaacccatttcaaaagttattggaaagaaagttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccatagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtg

SEQ ID NO: 105596 - DNA, 2856 bp, Homo sapiens
  Payload ID: 701
  Gene Symbol: AMIGO2
  Gene Name: adhesion molecule with Ig-like domain 2
  Uniprot ID: Q86SJ2
  ENST ID: ENST00000550413
  CDS Start-End: 352-1920
cgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgactaacccaggaaagaggaaaaaatacatttaacagtgaagaggcaacacagagctccctattgtgaaataaaacccatttcaaaagttattggaaagaaagtaaggttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccatagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatca

SEQ ID NO: 105597 - DNA, 2862 bp, Homo sapiens
  Payload ID: 702
  Gene Symbol: AMIGO3
  Gene Name: adhesion molecule with Ig-like domain 3
  Uniprot ID: Q86WK7
  ENST ID: ENST00000320431
  CDS Start-End: 231-1745
gaactcgcttggagagggctagcgaagccgaagggagcgcggctaagagtgccgcaccgcctcacaacctgggaaccggagagtaggggccgtcggctggcaagaacccgccgtgcctcctcggcaagggccatccggtgccacccatgtcgcactagagcagaagagggtgagtcctggaactgcaacctgcacagagctgctctgtactgtccctggtggtcgccgccatgacctggttggtgctgctggggacactgctctgcatgctgcgcgttgggttaggcaccccggactccgagggtttcccgccccgtgcgctccacaactgcccctacaaatgtatctgcgctgccgacctgctaagctgcactggcctagggctgcaggacgtgccagccgagttacctgccgctactgcggacctcgacctgagccacaacgcgctccagcgcctgcgccccggctggttggcgcccctcttccagctgcgcgccctgcacctagaccacaacgaactagatgcgctgggtcgcggcgtcttcgtcaacgccagcggcctgaggctgctcgatctatcatctaacacgttgcgggcgcttggccgccacgacctcgacgggctgggggcgctggagaagctgcttctgttcaataaccgcttggtgcacttggacgagcatgccttccacggcctgcgcgcgctcagccatctctacctgggctgcaacgaactcgcctcgttctccttcgaccacctgcacggtctgagcgccacccacctgcttactctggacctctcctccaaccggctgggacacatctccgtacctgagctggccgcgctgccggccttcctcaagaacggcctctacttgcacaacaaccctttgccttgcgactgccgcctctaccacctgctacagcgctggcaccagcggggcctgagcgccgtgcgcgactttgcgcgcgagtacgtatgcttggccttcaaggtacccgcgtcccgcgtgcgcttcttccagcacagccgcgtctttgagaactgctcgtcggccccagctcttggcctagagcggccggaagagcacctgtacgcgctggtgggtcggtccctgaggctttactgcaacaccagcgtcccggccatgcgcattgcctgggtttcgccgcagcaggagcttctcagggcgccaggatcccgcgatggcagcatcgcggtgctggccgacggcagcttggccataggcaacgtacaggagcagcatgcgggactcttcgtgtgcctggccactgggccccgcctgcaccacaaccagacgcacgagtacaacgtgagcgtgcactttccgcgcccagagcccgaggctttcaacacaggcttcaccacactgctgggctgtgccgtgggccttgtgctcgtgctgctctacctgttcgccccaccctgccgctgctgccgccgtgcctgccgctgccgccgctggccccaaacacccagcccgctccaagagctgagcgcacagtcctcagtactcagcaccacaccgccagacgcacccagccgcaaggccagcgtccacaagcacgtagtctttctggagccaggccggaggggcctcaatggccgcgtgcagctggcagtagctgaggaattcgatctctacaaccctggaggcctgcagctgaaggctggctctgagtccgccagctccataggctccgagggtcccatgacaacctagactgcccagggctcccccacccaggcccccaccctcttgctgctcgccctgctccctgcttcggtccagagaactggcagatactggtgggaagcactgtgcctggccccccagcttcctgtatgggcctcgaaacacaatgggccttctcgctcactggtagagacaggggttgtggtccccaacctgccttctgctctgcccctgcacaggacccaaaggccccaggccctgcaaggtgtgctagttcctgctttcccgcggacttcctagtgcccaaatgccctgtgaggctgagagacccaggcccctgtggctttcaacacagcacagctgtggaagtggctgtgttcttctacagcctgtggaagaacccctgtagcagagcctcccgtccaccctcaggggctgagacagctctcgaggagtggtgctcaagagctgacgcagggccacctccccttcccaagggggtgggagggagtgggcccacagggaaaagaaggcggctctgaaggaagatctcgcccacaccccaggacagaaagaggaaacaagcccgccctctggtgaaatgggactccctccatccaccaacacccaacctcctgaaagcttcacaacttcacgcagagtccggtgggcaggcaccaggcaggaaaggctcctcaagaggttcctggtggtctggcctaagccccagccagaggccctgctctctctggcctggggcatccacccgttgttctgaaggcagagcccattctgtgggctcacaagacacagtgaaggggatcatggcctgcacccctgcttttcagcagtaaaaagcccgaaaagcctggcgagcatggccgagctgggagggccgagccggaactccacgtccctcgagagcaggagcctcttaagggctggcactggtctcagcctaatggctgaggcggtaccctggcttcatatgcatctcactgctcccactgcaggggggcagggaaggggggtctgggagcccttcatgtgtgggggccgagctgggggcccccatggccatcctggacctcgctgctccagagtttaataaaggtagcacatgcttattgctagagcctttgca

SEQ ID NO: 105598 - DNA, 1959 bp, Homo sapiens
  Payload ID: 703
  Gene Symbol: AMICA1
  Gene Name: adhesion molecule, interacts with CXADR antigen 1
  Uniprot ID: Q86YT9
  ENST ID: ENST00000292067
  CDS Start-End: 443-1597
atcacttggctcttctctgatatgaactgggcagcatctaaatgtatctttcttgattttgttgtctctttgcatagagcatatcttgtgaaaacagaaatatccatgtaatggttttttcttgtagtgaccgctcgaaattgcttgagcaacatagagataatgggcaggggtccctgtgtgaagcacctagaggctggaaagctgatggcaaagctggaggggtgaggcagggagaggataaacacagtggaaatgcaggaggaaagctgtgctctgtggtggcctaattacaaggacctgccctacagccagaatcagccagcaaatgcttttgtaaaggaactaaaagaaagggaaaagaggaagtaaacaaaaggtcccttttcagagagggaaccagtgggagatttaagagcaaggaacaacccatttcgtcgttatggtaagtggagattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcatt

SEQ ID NO: 105599 - DNA, 1944 bp, Homo sapiens
  Payload ID: 703
  Gene Symbol: AMICA1
  Gene Name: adhesion molecule, interacts with CXADR antigen 1
  Uniprot ID: Q86YT9
  ENST ID: ENST00000356289
  CDS Start-End: 175-1359
ctgtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatcattcctctggcacattatttctaaataagtgttgtttgtggaaatcgtcctatttttatgcctcggttgagggggcaagtaaagtcctggtgaggaatttacagttagaaacttttggaaaaactgaagttcctggaggaaagccaaaccgtgctaacacactagaggctggttttggtcctgggaaaggtttggggtgaatgggttggaagtagggtatgaatac

SEQ ID NO: 105600 - DNA, 1383 bp, Homo sapiens
  Payload ID: 703
  Gene Symbol: AMICA1
  Gene Name: adhesion molecule, interacts with CXADR antigen 1
  Uniprot ID: Q86YT9
  ENST ID: ENST00000526620
  CDS Start-End: 156-1223
gcagtctttcagttgagcttggggactgcagctgtggggagatttcagtgcattgcctcccctgggtgctcttcatcttggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcag

SEQ ID NO: 105601 - DNA, 1935 bp, Homo sapiens
  Payload ID: 703
  Gene Symbol: AMICA1
  Gene Name: adhesion molecule, interacts with CXADR antigen 1
  ENST ID: ENST00000526595
  CDS Start-End: 517-1434
acttggctcttctctgatatgaactgggcagcatctaaatgtatctttcttgattttgttgtctctttgcatagagcatatcttgtgaaaacagaaatatccatgtaatggttttttcttgtagtgaccgctcgaaattgcttgagcaacatagagataatgggcaggggtccctgtgtgaagcacctagaggctggaaagctgatggcaaagctggaggggtgaggcagggagaggataaacacagtggaaatgcaggaggaaagctgtgctctgtggtggcctaattacaaggacctgccctacagccagaatcagccagcaaatgcttttgtaaaggaactaaaagaaagggaaaagaggaagtaaacaaaaggtcccttttcagagagggaaccagtgggagatttaagagcaaggaacaacccatttcgtcgttatgattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggtagaatggatattttcaggacggcgcgcaaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggaggtgaacacacgcttcagcctaaaacactaaaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgag

SEQ ID NO: 105602 - DNA, 574 bp, Homo sapiens
  Payload ID: 703
  Gene Symbol: AMICA1
  Gene Name: adhesion molecule, interacts with CXADR antigen 1
  ENST ID: ENST00000525565
  CDS Start-End: 110-574
gtagacctaaaaacatctgagagcctagaagtgcacagcagtgtgcagatagattgagaggacttggctctgcaggtggacaacactctatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgt

SEQ ID NO: 105603 - DNA, 591 bp, Homo sapiens
  Payload ID: 703
  Gene Symbol: AMICA1
  Gene Name: adhesion molecule, interacts with CXADR antigen 1
  ENST ID: ENST00000524477
  CDS Start-End: 230-591
atcagaaaggagagacttctggggtttcccttatttctttagaaaggttgggaggaagaattccagaaaagtgtaaggggctggataggaggagggagccagatagcatttattgtagtatgaagattgcagaatccttctgatgagccatatagattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcac

SEQ ID NO: 105604 - DNA, 547 bp, Homo sapiens
  Payload ID: 703
  Gene Symbol: AMICA1
  Gene Name: adhesion molecule, interacts with CXADR antigen 1
  ENST ID: ENST00000527877
  CDS Start-End: 173-373
gtttgcatctctgcaaccacttcagaaggcacgtgtttggtttgctctgagcctaacctagagtgctcgcagcagtctttcagttgagcttggggactgcagctgtggggagatttcagtgcattgcctcccctgggtgctcttcatcttggatttgaaagttgagagcagcatgttttgcccactgaaactcatcctgctgccagtgttactggagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgt

SEQ ID NO: 105605 - DNA, 1508 bp, Homo sapiens
  Payload ID: 703
  Gene Symbol: AMICA1
  Gene Name: adhesion molecule, interacts with CXADR antigen 1
  ENST ID: ENST00000533261
  CDS Start-End: 26-1177
ttaagatttgaaagttgagagcagcatgttttgcccactgaaactcatcctgctgccagtgttactggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttccagaaccgcgtacacttgatgggggacatcttatgcaatgatggctctctcctgctccaagatgtgcaagaggctgaccagggaacctatatctgtgaaatccgcctcaaaggggagagccaggtgttcaagaaggcggtggtactgcatgtgcttccagaggagcccaaagagctcatggtccatgtgggtggattgattcagatgggatgtgttttccagagcacagaagtgaaacacgtgaccaaggaggagattgtatttcgttactaccacaaactcaggatgtctgtggagtactcccagagctggggccacttccagaatcgtgtgaacctggtgggggacattttccgcaatgacggttccatcatgcttcaaggagtgagggagtcagatggaggaaactacacctgcagtatccacctagggaacctggtgttcaagaaaaccattgtgctgcatgtcagcccggaagagcctcgaacactggtgaccccggcagccctgaggcctctggtcttgggtggtaatcagttggtgatcattgtgggaattgtctgtgccacaatcctgctgctccctgttctgatattgatcgtgaagaagacctgtggaaataagagttcagtgaattctacagtcttggtgaagaacacgaagaagactaatccagagataaaagaaaaaccctgccattttgaaagatgtgaaggggagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacaggcctgctgaggggaggggagcatggacttggcctctggagtgggacactggccctgggaaccaggctgagctgagtggcctcaaaccccccgttggatcagaccctcctgtgggcagggttcttagtggatgagttactgggaa

SEQ ID NO: 105606 - DNA, 1478 bp, Homo sapiens
  Payload ID: 704
  Gene Symbol: ADRM1
  Gene Name: adhesion regulating molecule 1
  Uniprot ID: Q16186
  ENST ID: ENST00000253003
  CDS Start-End: 156-1379
gttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgcc

SEQ ID NO: 105607 - DNA, 1530 bp, Homo sapiens
  Payload ID: 704
  Gene Symbol: ADRM1
  Gene Name: adhesion regulating molecule 1
  Uniprot ID: Q16186
  ENST ID: ENST00000491935
  CDS Start-End: 206-1429
cgactgccgcctttttaccctgtggcctttcccatccaggcgtccagagggttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaa

SEQ ID NO: 105608 - DNA, 735 bp, Homo sapiens
  Payload ID: 704
  Gene Symbol: ADRM1
  Gene Name: adhesion regulating molecule 1
  ENST ID: ENST00000462554
  CDS Start-End: 312-735
gctcgggcgggtctgccccgcggagcgggtcgccggggtggcgcgtcgaggctggtgccccgcggagacggcgtcaagcctagggccggccccactaggcttggcggggctgccccggcccagcgccgagtgcgggcggtgcgatcgtcgtgagcggggcaaacgcggaaaggcagcccggcgtgtctgagtctgccttaggcagctctgggcgcaggccccctgctcgcaaacaccccagggggcgggagcttgccggaccgcaggcgacagtgaccgccgcgtctcagcgtcctctccgcgctttcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgg

SEQ ID NO: 105609 - DNA, 1361 bp, Homo sapiens
  Payload ID: 704
  Gene Symbol: ADRM1
  Gene Name: adhesion regulating molecule 1
  ENST ID: ENST00000620230
  CDS Start-End: 156-1262
gttagagccggctgcgcggcttacggggctcaatcggcggcgagagcggcaggcggggcgggccgaacgcgggtttccggcggggcccggcaggcgccgaggaggaagagcgagcccggacggcgcctctcgaacgagtgtgggcgcgaggcaggatgacgacctcaggcgcgctctttccaagcctggtgccaggctctcggggcgcctccaacaagtacttggtggagtttcgggcgggaaagatgtccctgaaggggaccaccgtgactccggataagcggaaagggctggtgtacattcagcagacggacgactcgcttattcacttctgctggaaggacaggacgtccgggaacgtggaagacgaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgcc

SEQ ID NO: 105610 - DNA, 2430 bp, Homo sapiens
  Payload ID: 705
  Gene Symbol: APMAP
  Gene Name: adipocyte plasma membrane associated protein
  Uniprot ID: Q9HDC9
  ENST ID: ENST00000217456
  CDS Start-End: 292-1542
tcgcgttctgggccccggagtccgagacaggcggggaccccggcagctcccggtgctatctctgagcgggttccgagccccacttccgggcggtcagaattagcctcagagcgccgagcaacgacgcgccggggacctcccgcccatgaggccggaaggggcggggagaacgctgcggaatggtccctgggcgcaacgtcatttccgcgtacgggggagggcgggcctggagtctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttt

SEQ ID NO: 105611 - DNA, 2117 bp, Homo sapiens
  Payload ID: 705
  Gene Symbol: APMAP
  Gene Name: adipocyte plasma membrane associated protein
  ENST ID: ENST00000451442
  CDS Start-End: 1-1229
aggtcgtcacagacgatgatggccaggccccggaggctaaggacggcagctcctttagcggcagagttttccgagtgaccttcttgatgctggctgtttctctcaccgttcccctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggacagcagatggccgggtcgtaaaacttgaaaatggtgaaatagagaccattgcccggtttggttcgggcccttgcaaaacccgagatgatgagcctgtgtgtgggagacccctgggtatccgtgcagggcccaatgggactctctttgtggccgatgcatacaagggactatttgaagtaaatccctggaaacgtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcgcctgctggagtatgatactgtgaccagggaagtaaaagttttattggaccagctgcggttcccgaatggagtccagctgtctcctgcagaagactttgtcctggtggcagaaacaaccatggccaggatacgaagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaagggaagctgcgctggttgtgatctgctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttt

SEQ ID NO: 105612 - DNA, 619 bp, Homo sapiens
  Payload ID: 706
  Gene Symbol: AAMDC
  Gene Name: adipogenesis associated, Mth938 domain containing
  ENST ID: ENST00000304716
  CDS Start-End: 148-591
gcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggctccaacccagcagctgccatcaggtgttcatgtcagggctgtggtacaattccacctggctacagcttcatggcacatccttgagagatgcaaaacaggagctggactgagcatcaaacatgtctgtgagctggcaatgagtcacctaagtacttttttgtatcaaatctatgatgccatcattcttaagatgcacctttattttatgaaatagtaagaaacaaaaaacactatgggacacc

SEQ ID NO: 105613 - DNA, 531 bp, Homo sapiens
  Payload ID: 706
  Gene Symbol: AAMDC
  Gene Name: adipogenesis associated, Mth938 domain containing
  Uniprot ID: Q9H7C9
  ENST ID: ENST00000393427
  CDS Start-End: 117-485
agttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctatgcctgtga

SEQ ID NO: 105614 - DNA, 579 bp, Homo sapiens
  Payload ID: 706
  Gene Symbol: AAMDC
  Gene Name: adipogenesis associated, Mth938 domain containing
  Uniprot ID: Q9H7C9
  ENST ID: ENST00000526415
  CDS Start-End: 174-542
gtattcccggagggcagttggggagcgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 105615 - DNA, 511 bp, Homo sapiens
  Payload ID: 706
  Gene Symbol: AAMDC
  Gene Name: adipogenesis associated, Mth938 domain containing
  ENST ID: ENST00000525034
  CDS Start-End: 49-474
ccttttataatgaacctactactcctgcaataacagcataatctattcatgagggtggaaccctcatggcctaatcagctcttaaagacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 105616 - DNA, 693 bp, Homo sapiens
  Payload ID: 706
  Gene Symbol: AAMDC
  Gene Name: adipogenesis associated, Mth938 domain containing
  ENST ID: ENST00000527134
  CDS Start-End: 149-562
cgcagatcccgaagcagcgctgggagcgtaagtgcgggcagagcactgcgccgtttgggaacgcaactttgaggagacagtgcggtggttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggctccaacccagcagctgccatcaggtgttcatgtcagggctgtggtacaattccacctggctacagcttcatggcacatccttgagagatgcaaaacagaccaggaactagaacagcttggtgttttctcaactttattgtggacaggagaagggagctggactgagcatcaaacatgtctgtgagctggcaatgagtcacctaagtacttttttgtatcaaatctatgatgccatcattcttaagatgcacctttattttatgaaatagtaagaaacaaaaaacactatgggacaccatcaaaatatctgatttc

SEQ ID NO: 105617 - DNA, 690 bp, Homo sapiens
  Payload ID: 706
  Gene Symbol: AAMDC
  Gene Name: adipogenesis associated, Mth938 domain containing
  Uniprot ID: Q9H7C9
  ENST ID: ENST00000532481
  CDS Start-End: 91-357
gcgctgttcaactgcagggcgtattcccggagggcagttggggagcgcagatcccgaagcagcgctgggagcacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggatggaatacagggggcacagttagatctgaattgttaagcagaggctgcttgatgcagaagatgaagacagaagaaagaatgagcctaggccgggcacagtggctcacgcctgtaattccagcactttgggaggccgaggcgggaggatcacttgagctcaggagtttgagaccagcctggccaccatggtgaaacctcgactctacaaaaaaaaaaaagccaaaattagccaggtgtggtggcatatgcctgtggtcccagctacttgggaggctgaagtgggagaatcacttgcagtgagctgatattatgccactgcactccagcctgggtgacagggtgagaccctgtctcaaaaaaaaaaaaaaaa

SEQ ID NO: 105618 - DNA, 421 bp, Homo sapiens
  Payload ID: 706
  Gene Symbol: AAMDC
  Gene Name: adipogenesis associated, Mth938 domain containing
  ENST ID: ENST00000525409
  CDS Start-End: 112-384
gcgggcagagcactgcgccgtttgggaacgcaactttgaggagacagtgcgttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgccta

SEQ ID NO: 105619 - DNA, 726 bp, Homo sapiens
  Payload ID: 706
  Gene Symbol: AAMDC
  Gene Name: adipogenesis associated, Mth938 domain containing
  ENST ID: ENST00000526164
  CDS Start-End: 147-428
gttcaactgcagggcgtattcccggagggcagttggggagcgcagatcccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaagggtcttactctgccacccaggctggagtgcagtggcacgatcataactcactgaagcctcaaactcctgggcgcaagtgatcttcctgcctcagcctcctgaggagtggggattacaggcacgtgccaccacgccaggagctggactgagcatcaaacatgtctgtgagctggcaatgagtcacctaagtacttttttgtatcaaatctatgatgccatcattcttaagatgcacctttattttatgaaatagtaagaaacaaaaaacactatgggacaccatcaaaatatctgatttcagagaagttacaataataaaaaatgtgtatcttggaatcaatgaaatgtggca

SEQ ID NO: 105620 - DNA, 606 bp, Homo sapiens
  Payload ID: 706
  Gene Symbol: AAMDC
  Gene Name: adipogenesis associated, Mth938 domain containing
  ENST ID: ENST00000533193
  CDS Start-End: 61-567
ttctggaggctgggaagtccaagaccagttggctcgcatctgacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagagtctcactctgttgcccaggctggagtgcagtggcgcgatctcggctcactgcaacctccacctcccaggttcatgccattctcctgcctcagcctcccaagtagctgggactacaggtgcctgccaccacacccagcattctcctggtgtgcagcctgcagatgtgaaggaagttgttgagaagggtgtacagactcttgtgattggccgagggatgagtgaggccttgaaggtgccttcatcaactgtggagtacctcaagaaacatggcattgatgtgcgggtcctccagacagagcaggcagtgaaggagtataatgccttggttgcccaaggggtcagggtgggaggtgtcttccattccacctgctgatggagccttaagaggagaataaatcactaagtgcctatg

SEQ ID NO: 105621 - DNA, 440 bp, Homo sapiens
  Payload ID: 706
  Gene Symbol: AAMDC
  Gene Name: adipogenesis associated, Mth938 domain containing
  ENST ID: ENST00000529666
  CDS Start-End: 1-156
aggctccaacccagcagctgccatcaggtgttcatgtcagggctgtggtacaattccacctggctacagcttcatggcacatccttgagagatgcaaaacagggtcttactctgccacccaggctggagtgcagtggcacgatcataactcactgaagcctcaaactcctgggcgcaagtgatcttcctgcctcagcctcctgaggagtggggattacaggcacgtgccaccacgccaggagctggactgagcatcaaacatgtctgtgagctggcaatgagtcacctaagtacttttttgtatcaaatctatgatgccatcattcttaagatgcacctttattttatgaaatagtaagaaacaaaaaacactatgggacaccatcaaaatatctgatttcagagaagttacaataataaaaaatgtgtatcttggaatc

SEQ ID NO: 105622 - DNA, 542 bp, Homo sapiens
  Payload ID: 706
  Gene Symbol: AAMDC
  Gene Name: adipogenesis associated, Mth938 domain containing
  ENST ID: ENST00000630098
  CDS Start-End: 99-542
ccgaagcagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggctccaacccagcagctgccatcaggtgttcatgtcagggctgtggtacaattccacctggctacagcttcatggcacatccttgagagatgcaaaacaggagctggactgagcatcaaacatgtctgtgagctggcaatgagtcacctaagtacttttttgtatcaaatctatgatgccatcattcttaagatgcacctttattttatgaaatag

SEQ ID NO: 105623 - DNA, 917 bp, Homo sapiens
  Payload ID: 707
  Gene Symbol: ADIRF
  Gene Name: adipogenesis regulatory factor
  Uniprot ID: Q15847
  ENST ID: ENST00000372013
  CDS Start-End: 354-584
aaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcg

SEQ ID NO: 105624 - DNA, 229 bp, Homo sapiens
  Payload ID: 707
  Gene Symbol: ADIRF
  Gene Name: adipogenesis regulatory factor
  ENST ID: ENST00000416348
  CDS Start-End: 114-229
aggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgccatggaccagctggccaagaccacccaggaaaccatcgacaagactgctaacca

SEQ ID NO: 105625 - DNA, 700 bp, Homo sapiens
  Payload ID: 707
  Gene Symbol: ADIRF
  Gene Name: adipogenesis regulatory factor
  Uniprot ID: Q15847
  ENST ID: ENST00000561504
  CDS Start-End: 56-286
caggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcggtaaaatacctgttttctgacaagactaggactcttacatagactgccatgaactacaagaagtatagcattgctcaaata

SEQ ID NO: 105626 - DNA, 430 bp, Homo sapiens
  Payload ID: 708
  Gene Symbol: ADIG
  Gene Name: adipogenin
  ENST ID: ENST00000373348
  CDS Start-End: 46-225
ctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagatattctgcaagtcagaagatacagatatgatgcaaacattttaacagcttcatgacaagccatcagacggagggtccgggtctccatgtggtgtgactctcccacagcttagtcacccagatctctcgtgatctgtggacgtggacacagtttccaggtgttttattgttcgtgtgtgcgtgtttcatcacaaaacagggctacagtggagatcattgtgcctttgtactcagatgtttgttaatgaatgaactagtgga

SEQ ID NO: 105627 - DNA, 547 bp, Homo sapiens
  Payload ID: 708
  Gene Symbol: ADIG
  Gene Name: adipogenin
  ENST ID: ENST00000416116
  CDS Start-End: 1-539
tctggttctgcctccctgtgggtttgctgttgttattgatcatctggctacgcttcttacttagccaagattcagaggaaaatgactccagtgtgtgcttggattgggagccctggagcaaaggcccagctgagttttgctggaaggggacactccacggccaagagaaggagaggccctgctgtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaaccta

SEQ ID NO: 105628 - DNA, 772 bp, Homo sapiens
  Payload ID: 708
  Gene Symbol: ADIG
  Gene Name: adipogenin
  Uniprot ID: Q0VDE8
  ENST ID: ENST00000470147
  CDS Start-End: 57-299
atggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagattcagaggaaaatgactccagtgtgtgcttggattgggagccctggagcaaaggcccagctgagttttgctggaaggggacactccacggccaagagaaggagaggccctgctggtgagcctgctgtgccaggtgaggcccttccaggggccagggggagcctcaaggcccacccaaagccttgggcagctgctatgtgggcaagaggctgcctccaccatattagagtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaaccta

SEQ ID NO: 105629 - DNA, 770 bp, Homo sapiens
  Payload ID: 708
  Gene Symbol: ADIG
  Gene Name: adipogenin
  Uniprot ID: Q0VDE8
  ENST ID: ENST00000537425
  CDS Start-End: 57-299
atggggcagccctgccagcccagcccaggctggcccagcttagccacacatgcgccatgaagtaccctttgatgccgctggtgaacgacctcacattttctttcctggttttctggttctgcctccctgtgggtttgctgttgttattgatcatctggctacgcttcttacttagccaagattcagaggaaaatgactccagtgtgtgcttggattgggagccctggagcaaaggcccagctgagttttgctggaaggggacactccacggccaagagaaggagaggccctgctggtgagcctgctgtgccaggtgaggcccttccaggggccagggggagcctcaaggcccacccaaagccttgggcagctgctatgtgggcaagaggctgcctccaccatattagagtttggttttcctggagtcagcagggcagtggcaatggcagaagtggatgggagagacttgccagggaggcaagaggactttggcaactgtggtgcctccctggaacccccaactcatctcctcttcagaccgacatgtgaaagcctccagaggtcccagcccttctccagcatcacagatgacctccagccctgcagggagccgctcaagtctgggagggcatgggagcagtgagcaggcccatggggagaaattggccaatttaattcagaggggtcttaaagcagggctgggccggagggtgtgggtccatattaaagaagcaagggtcttcccatacccgggggacccctgacaaacc

SEQ ID NO: 105630 - DNA, 2177 bp, Homo sapiens
  Payload ID: 709
  Gene Symbol: ADIPOR1
  Gene Name: adiponectin receptor 1
  Uniprot ID: Q96A54
  ENST ID: ENST00000340990
  CDS Start-End: 300-1427
ctccgcgagagggcctaggattggagggcccaggcagagcccgcgaggaggtgacgcggctgcggaggtgacgcgggaggtcgcgcgccccttccggcgcggggagggcgctgaagatcggggccgctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctgagttgtctgtttctagaagaaacctcttagagaattcagtaccaaccaagcttcagcccactttcacacccactgggcaataaactttccatttccattctcctagctggggatggggcatggtcaaacttagccatcccctcctcagcaaggcatctaccggcccctcacagagacagtactttgaaactcatgttgagattttaccctctcctccaaccattttgggaaaattatggactgggactcttcagaaattctgtcttttcttctggaagaaaatgtccctcccttacccccatccttaactttgtatcctggcttataacaggccatccatttttgtagcacacttttcaaaaacaattatataccctggtcccatctttctagggcctggatctgcttatagagcaggaagaataaagccaccaacttttacctagcccggctaatcatggaagtgtgtccaggcttcaagtaacttgagttttaattttttttttttcttggcagagtaatgtaaaatttaaatggggaaagatatttaatatttaatactaagctttaaaaagaaacctgctatcattgctatgtatcttgatgcaaagactatgatgttaataaaagaaagtacagaagacacttggcattcaaagatttcaca

SEQ ID NO: 105631 - DNA, 1116 bp, Homo sapiens
  Payload ID: 709
  Gene Symbol: ADIPOR1
  Gene Name: adiponectin receptor 1
  ENST ID: ENST00000367254
  CDS Start-End: 175-690
gctcggccgcaggccgcctccagcgccgcgggatgtagcgcgggggaccgcggcccccagcagagcccgcctgcccggcttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttgccacggctcatctacctctccatcgtctgtgtcctgggcatttctgccatcattgtggcgcagtgggaccggtttgccactcctaagcaccggcagacaagagcaggcgtgttcctgggacttggcttgagtggcgtcgtgcccaccatgcactttactatcgctgagggctttgtcaaggccaccacagtgggccagatgggctggttcttcctcatggctgtgatgtacatcactggagctggcctttatgctgctcgaattcctgagcgcttctttcctggaaaatttgacatatggttccagtctcatcagattttccatgtcctggtggtggcagcagcctttgtccacttctatggagtctccaaccttcaggaattccgttacggcctagaaggcggctgtactgatgacacccttctctgagccttcccacctgcggggtggaggaggaacttcccaagtgcttttaaaaataacttctttgctgaagtgagaggaagagtctg

SEQ ID NO: 105632 - DNA, 879 bp, Homo sapiens
  Payload ID: 709
  Gene Symbol: ADIPOR1
  Gene Name: adiponectin receptor 1
  ENST ID: ENST00000426229
  CDS Start-End: 263-879
agggcgctgaagatcggggccgctcggccgcaggccgcctccagcgccgcgggatgtagcgcgggggaccgcggcccccagcagagcccgcctgcccggcttttagaagaccaaactggacaatggactttgctcactatgatgacatgatctccattgacctccatttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaa

SEQ ID NO: 105633 - DNA, 1058 bp, Homo sapiens
  Payload ID: 709
  Gene Symbol: ADIPOR1
  Gene Name: adiponectin receptor 1
  ENST ID: ENST00000417068
  CDS Start-End: 260-1058
atcacgcacttcaggctgcgataacgaggtggagtgtagaatccgacgaacgtcctctaccccggggcgggtggaggttacctggctgcggcggggagtttagaagaccaaactggacaatggactttgctcactatgatgacatgatctccattgacctccatttgtctaccatcagagggagatctctgccccctggggctgagagaccccaacctttccccaagctgaagctgcagggtattgaggtaccagccagatgtcttcccacaaaggatctgtggtggcacaggggaatggggctcctgccagtaacagggaagctgacacggtggaactggctgaactgggacccctgctagaagagaagggcaaacgggtaatcgccaacccacccaaagctgaagaagagcaaacatgcccagtgccccaggaagaagaggaggaggtgcgggtactgacacttcccctgcaagcccaccacgccatggagaagatggaagagtttgtgtacaaggtctgggagggacgttggagggtcatcccatatgatgtgctccctgactggctaaaggacaacgactatctgctacatggtcatagacctcccatgccctcctttcgggcttgcttcaagagcatcttccgcattcatacagaaactggcaacatctggacccatctgcttggtttcgtgctgtttctctttttgggaatcttgaccatgctcagaccaaatatgtacttcatggcccctctacaggagaaggtggtttttgggatgttctttttgggtgcagtgctctgcctcagcttctcctggctctttcacaccgtctattgtcattcagagaaagtctctcggactttttccaaactggactattcagggattgctcttctaattatggggagctttgtcccctggctctattattccttctactgctccccacagccacggctcatctacctctccatcgtctgtgtcctgggcatttctgccatcattgtggcgcagtgggaccggtttgccactcctaagcaccggcagacaa

SEQ ID NO: 105634 - DNA, 4018 bp, Homo sapiens
  Payload ID: 710
  Gene Symbol: ADIPOR2
  Gene Name: adiponectin receptor 2
  Uniprot ID: Q86V24
  ENST ID: ENST00000357103
  CDS Start-End: 252-1412
gcggcggcggcggtcgctgtcgcggcggcgagagcgcgattccagaagcggcatcgcggcggcggcagcggcggcggctacaccgggcttggccccctccctcctccgttcccccctcctcccccctcccctcagcggtggctcccaagaagtccgagacacgcggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccagtggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggcgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatg

SEQ ID NO: 105635 - DNA, 4562 bp, Homo sapiens
  Payload ID: 711
  Gene Symbol: ADIPOQ
  Gene Name: adiponectin, C1Q and collagen domain containing
  Uniprot ID: Q15848
  ENST ID: ENST00000320741
  CDS Start-End: 69-803
gccatctcctcctcacttccattctgactgcagtctgtggttctgattccataccagaggggctcaggatgctgttgctgggagctgttctactgctattagctctgcccggtcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcgagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgacgtcctgtcttggaaggactactactcaatggcccctgcactactctacttcctcttacctatgtcccttctcatgcctttccctccaacggggaaagccaactccatctctaagtgccgaactcatccctgttcctcaaggccacctggccaggagcttctctgatgtgatatccactttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggttttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgttcttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggttcaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccatttttgttgttattttttgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggttggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctctttccttccttccttcctccttttctttctctctctctctctctctctttttttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgtttagacaatttatatttaataaaattgttgaatttaa

SEQ ID NO: 105636 - DNA, 4599 bp, Homo sapiens
  Payload ID: 711
  Gene Symbol: ADIPOQ
  Gene Name: adiponectin, C1Q and collagen domain containing
  Uniprot ID: Q15848
  ENST ID: ENST00000444204
  CDS Start-End: 106-840
acttccattctgactgcagtctgtggttctgattccataccagaggagacgggatttcaccatgttgtccaggctggtctgaaactcctgacatcagggctcaggatgctgttgctgggagctgttctactgctattagctctgcccggtcatgaccaggaaaccacgactcaagggcccggagtcctgcttcccctgcccaagggggcctgcacaggttggatggcgggcatcccagggcatccgggccataatggggccccaggccgtgatggcagagatggcacccctggtgagaagggtgagaaaggagatccaggtcttattggtcctaagggagacatcggtgaaaccggagtacccggggctgaaggtccccgaggctttccgggaatccaaggcaggaaaggagaacctggagaaggtgcctatgtataccgctcagcattcagtgtgggattggagacttacgttactatccccaacatgcccattcgctttaccaagatcttctacaatcagcaaaaccactatgatggctccactggtaaattccactgcaacattcctgggctgtactactttgcctaccacatcacagtctatatgaaggatgtgaaggtcagcctcttcaagaaggacaaggctatgctcttcacctatgatcagtaccaggaaaataatgtggaccaggcctccggctctgtgctcctgcatctggaggtgggcgaccaagtctggctccaggtgtatggggaaggagagcgtaatggactctatgctgataatgacaatgactccaccttcacaggctttcttctctaccatgacaccaactgatcaccactaactcagagcctcctccaggccaaacagccccaaagtcaattaaaggctttcagtacggttaggaagttgattattatttagttggaggcctttagatattattcattcatttactcattcatttattcattcattcatcgagtaactttaaaaaaatcatatgctatgttcccagtcctggggagcttcacaaacatgaccagataactgactagaaagaagtagttgacagtgctattttgtgcccactgtctctcctgatgctcatatcaatcctataaggcacagggaacaagcattctcctgtttttacagattgtatcctgaggctgagagagttaagtgaatgtctaaggtcacacagtattaagtgacagtgctagaaatcaaacccagagctgtggactttgttcactagactgtgcccttttatagaggtacatgttctctttggagtgttggtaggtgtctgtttcccacctcacctgagagccattgaatttgccttcctcatgaattaaaacctcccccaagcagagcttcctcagagaaagtggttctatgatgacgtcctgtcttggaaggactactactcaatggcccctgcactactctacttcctcttacctatgtcccttctcatgcctttccctccaacggggaaagccaactccatctctaagtgccgaactcatccctgttcctcaaggccacctggccaggagcttctctgatgtgatatccactttttttttttttgagatggagtctcactctgtcacccaggctggagtacagtgacacgacctcggctcactgcagcctccttctcctgggtccaagcaattattgtgcctcagcctcccgagtagctgagacttcaggtgcattccaccacacatggctaatttttgtatttttagtagaaatggggtttcgtcatgttggccaggctggtctcgaactcctggcctaggtgatccacccgcctcgacctcccaaagtgctgggattacaggcatgagccaccatgcccagtcgatatctcactttttattttgccatggatgagagtcctgggtgtgaggaacacctcccaccaggctagaggcaactgcccaggaaggactgtgcttccgtcacctctaaatcccttgcagatccttgataaatgcctcatgaagaccaatctcttgaatcccatatctacccagaattaactccattccagtctctgcatgtaatcagttttatccacagaaacattttcattttaggaaatccctggttttaagtatcaatccttgttcagctggacaatatgaatcttttccactgaagttagggatgactgtgattttcagaacacgtccagaatttttcatcaagaaggtagcttgagcctgaaatgcaaaacccatggaggaattctgaagccattgtctccttgagtaccaacagggtcagggaagactgggcctcctgaatttattattgttctttaagaattacaggttgaggtagttgatggtggtaaacattctctcaggagacaataactccagtgatgttcttcaaagattttagcaaaaacagagtaaatagcattctctatcaatatataaatttaaaaaactatctttttgcttacagttttaaattctgaacaattctctcttatatgtgtattgctaatcattaaggtattattttttccacatataaagctttgtctttttgttgttgttgttgtttttaagatggagtttccctctgttgccaggctagagtgcagtggcatgatctcggcttactgcaacctttgcctcccaggttcaagcgattcttctgcctcagcctcccgagtagctgggaccacaggtgcctaccaccatgccaggctaatttttgtatttttagtaaagacagggtttcaccatattggccaggctggtctcgaactcctgaccttgtgatctgcccgcctccatttttgttgttattttttgagaaagatagatatgaggtttagagagggatgaagaggtgagagtaagccttgtgttagtcagaactctgtgttgtgaatgtcattcacaacagaaaacccaaaatattatgcaaactactgtaagcaagaaaaataaaggaaaaatggaaacatttattcctttgcataatagaaattaccagagttgttctgtctttagataaggtttgaaccaaagctcaaaacaatcaagacccttttctgtatgtccttctgttctgccttccgcagtgtaggctttaccctcaggtgctacacagtatagttctagggtttccctcccgatatcaaaaagactgtggcctgcccagctctcgtatccccaagccacaccatctggctaaatggacatcatgttttctggtgatgcccaaagaggagagaggaagctctctttcccagatgccccagcaagtgtaaccttgcatctcattgctctggctgagttgtgtgcctgtttctgaccaatcactgagtcaggaggatgaaatattcatattgacttaattgcagcttaagttaggggtatgtagaggtattttccctaaagcaaaattgggacactgttatcagaaataggagagtggatgatagatgcaaaataatacctgtccacaacaaactcttaatgctgtgtttgagctttcatgagtttcccagagagacatagctggaaaattcctattgattttctctaaaatttcaacaagtagctaaagtctggctatgctcacagtctcacatctggttggggtgggctccttacagaacacgctttcacagttaccctaaactctctggggcagggttattcctttgtggaaccagaggcacagagagagtcaactgaggccaaaagaggcctgagagaaactgaggtcaagatttcaggattaatggtcctgtgatgctttgaagtacaattgtggatttgtccaattctctttagttctgtcagcttttgcttcatatattttagcgctctattattagatatatacatgtttagtattatgtcttattggtgcatttactctcttatcattatgtaatgtccttctttatctgtgataattttctgtgttctgaagtctactttgtctaaaaataacatacgcactcaacttccttttctttcttccttcctttctttcttccttcctttctttctctctctctctctttccttccttccttcctccttttctttctctctctctctctctctctttttttgacagactctcgttctgtggccctggctggagttcagtggtgtgatcttggctcactgctacctctaccatgagcaattctcctgcctcagcctcccaagtagctggaactacaggctcatgccactgcgcccagctaatttttgtatttttcgtagagacggggtttcaccacattcgtcaggttggtttcaaactcctgactttgtgatccacccgcctcggcctcccaaagtgctgggattacaggcatgagccatcacacctggtcaactttcttttgattagtgtttttgtggtatatctttttccatcatgttactttaaatatatctatattattgtatttaaaatgtgtttcttacagactgcatgtagttgggtataatttttatccagtctaaaaatatctgtcttttaattggtgtttagacaatttatatttaataaaattgttgaatttaa

SEQ ID NO: 105637 - DNA, 5393 bp, Homo sapiens
  Payload ID: 712
  Gene Symbol: ADNP2
  Gene Name: ADNP homeobox 2
  Uniprot ID: Q6IQ32
  ENST ID: ENST00000262198
  CDS Start-End: 456-3851
acgagagtttgcacagatgtggaaaggagctggcagggcagttccctgggacagaagggagtcagggggtccaacaggggccccccactgccaccccagagcctccagtccatctttagccaggggccccggggggcctgtgggaagtgccaggggcccccaagcacactctgctctcattggctggctgcgcctacatgcaaatgagggccaacgtcacttcctgaggccaatcgagcgccattttctctttctggctgcgcgggaggaggggaccagtcgcgctgggggtgggcgcgcgctgaggcgggggtcccgccgcgcggggcggaggcgcgggcgggcgcaggcggccccacgggacgcggctgcgctcggcggaagacgcggcagccctgcgagaggcagcagcggagacgcggtgctcctcgggcgccaagcggaaaatttcaaaaatgtttcaaattcctgtggaaaatcttgacaacatcagaaaggtgcgaaaaaaggtgaaaggtattcttgtggatattgggcttgacagctgcaaggagttactgaaggaccttaaaggctttgatccaggagagaaatactttcataacacatcatggggtgatgtttctctctgggaaccttctggaaagaaagtgagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatttcagaacatattaagaggactggactcttgaagcaaacgcacattgctccaaaaccagcagcacatttggctgcaccagcaaatggcagtgctccaagcgctccagcgcagcctccttgcttccatcttgctttgccacagaacagtccaagcccagccgcaggacagccagtgactgtggcccagggtgcccctggaagcctcactcattccccccctgctgctggccaatcccacatgactctggtctccagccctctgcctgtgggccagaacagcctcaccctgcagcccccagcacctcagcccgtctttctttctcacggggttccacttcatcagtctgtgaatcctcctgtgttgcccttgagtcagccagtcggacctgtcaataagtctgttggaactagtgtcctccccataaatcagactgttcgccctggggttttacccctcacccagcctgtgggacccataaacagacctgttgggcctggtgttcttcctgtgagcccctctgtcacccctggggtcctgcaggctgtctcgccaggggtgctttctgtgagtcgggcggtcccgtctggagtccttcctgcaggccagatgactcctgcaggccagatgactcctgcaggggttatccctgggcaaacagcaacttctggggttcttcctactggccagatggtccagtcaggagttctccctgtgggccagacagctccgtcacgggttcttcccccaggccagacagccccattgagggttatctctgcaggccaggtggtcccgtctgggcttctttctcccaaccagacagtctcctcctcagctgttgtgcctgtaaaccagggtgtgaattctggtgttctgcagcttagtcagcctgttgtgtcgggagttcttcctgtgggccagccagtgaggcctggggtcttgcaactcaaccagactgtgggcaccaacattctgcctgtgaatcagccagtgagacctggtgcttcgcagaacaccaccttcctgacatcaggctctattctcagacagctcatccctacagggaaacaagtgaatgggattccaacctacacgctggcccccgtgtctgtcactctgccggttccccctggaggccttgcgactgtcgctccgccccagatgcccatccagctcctgccgtcaggtgcagctgcaccaatggccggttccatgcccggcatgccctctcctccagtgctggtgaatgctgctcagagcgtgtttgttcaggcctcctcctctgcagcagacacaaaccaggtgctcaaacaggccaagcagtggaagacctgccctgtctgcaacgagctctttccgtccaacgtctaccaggtccacatggaggtagcgcataagcacagcgagtccaagtctggtgagaaacttgagcctgaaaaactggcagcgtgtgcaccatttctaaagtggatgagagagaaaacggtgcgatgtctgtcttgtaagtgcttggtctctgaggaagagcttatacaccacttgctgatgcatggcttggggtgcttgttctgtccatgcaccttccatgatatcaaaggtctttcagagcacagcaggaataggcacctggggaagaagaagttgcctatggattatagcaacagaggttttcaattagatgtcgatgccaatggcaacctgctctttccccaccttgatttcatcaccatattgccaaaggagaagcttggggagcgggaagtctacttggcaatcctggctgggatacactccaagtcactggtgcctgtgtatgtgaaggtgaggcctcaggctgagggcacccccgggagcaccggcaagcgagtgtccacctgccccttttgctttggcccctttgtgacaactgaggcctatgagctgcatttgaaggagaggcaccacatcatgcccacagtccacacggtcctgaagtctcccgccttcaagtgcatccactgctgtggggtctacacgggaaatatgaccctggctgccatcgccgtccatttggtgcgctgcagaagtgctcccaaggacagcagctcagacctgcaggcccagccgggttttattcacaacagtgaactgcttttagtcagtggtgaagtgatgcatgattccagtttttctgttaagagaaagctgcctgacggccacttaggggccgaagaccagcggcatggggaggagcagcctcccatcctaaatgccgatgcagccccgggtccagaaaaggtgacgagtgttgtgccttttaaaagacaaaggaatgaaagcagaacagagggacctattgtcaaggacgaggctcttcagattttagcattagatcctaaaaaatatgaaggccgttcttatgaagaaaagaagcaatttcttaaagattatttccataagaaaccatatcctagtaaaaaggaaatagaactgttgtcctcactcttttgggtgtggaaaattgatgtggcttcattttttggaaaaagaaggtatatttgcatgaaagcaataaaaaatcacaagccttctgtacttttaggctttgatatgtctgaacttaaaaatgtgaaacatagattgaactttgaatatgaaccataaaacttgcaaaaaaaaaaaaaagtaactctaaagtagtaggtagatttttttcagttgaaatttcacagtgttgtcctcactgtgttggtgaatcaacctcagtggtcactgtgctgctctgcagagttacttcaggtgctggagagacccctgttaccaggaagccagtagttatttcacatctattgtttcctgcagtttgatttgtaacagaacagttgttttcaggtttttttctctgtcatgtaaatgaaatcttttgatatttcatgcacgccttgttttcccactagtgtcagtatcgtatgataagaaactgaaatctataaataatttgctttttcattaaggacatttcagcctttttcagaatacttgatttaactgcgagtggaagcatcgatctccttcagctttccctgtagcagcagatggtacagtgagtgttcagagacgtgggtacaaaccctgtgatgtatgtataaggctccctgaggatgcactgcattaacttacgctgacttctttgtaagatctttgcttatagattataatttagatctgtatttttttaggtttatcctaatagctgtttttttttttaaccataactcatagaaaatcaaatgtttttatttgttaaaagtagactgaatttgacatctggtatgctggtatgtagctcatacatcaagagttattttacaaataaatttattctgtagatgcagaaatatttttcagtgtagattttcccttttgatatgctaagtcatttctccgttcagaggtaaaacaataaatttttagtgcctttagaataaacattgaaagaatacaccccaaaactcttctcctaacttaactactcataaactagtgaaagggaaggtctatgatactcaggaataagattattgcccctgagtgtgaaaactaacttaaatttcagcatagggtttcaggggacatggcgaagtttacagactgagatctcagtctccatggttggtacagtaagtctttgaccacattttctgaaggtcatgtttagtggagaaacgggcttttctctagctggtttaggctggaagctgtgtccgggtcgatgggatggcatattgttaaagaatctccattgtcgtcactgtcctgtggatgttaaacctcgtttttttccccacacgatattaaaacttaaagcaccagaaccagtcatggagaccagccagtttagatggtaagtcatatttctggtggtacacagcagaggaaccccttcactctatctttaggtagaaatatttggaggatgtgacagcctctgagaaacataatgttactatgtggattttaaaaaatataatacttgcatgtaattgctataatgttcatatttgaggcagttgtgaaactggtttatgattgttggtgtactctgttgtaaattcaaagagagcttgttgaacattttttttttttacctattgttttcagagtgtctattttgaattaaaatttgttacaccgctgcaaatagaa

SEQ ID NO: 105638 - DNA, 823 bp, Homo sapiens
  Payload ID: 712
  Gene Symbol: ADNP2
  Gene Name: ADNP homeobox 2
  ENST ID: ENST00000559951
  CDS Start-End: 310-823
acgtgggagcgggggccgccccgggagggcggagaaggggatggggacctgaggggagagtaggaataggggaaagacgaggacggggaccgagggagagaggggggctggtgaagggagcgaggagtagagggagagggaacggggatggagaagaagagagggggcaaggagctgtggcgacccctgtaaggactccagaaacgccccgcccgctggcccgcccgccgcatccccgagaccgggttctcctggaagcttctctctggaggagccttgagtgacggcagatgtaggaaaatttcaaaaatgtttcaaattcctgtggaaaatcttgacaacatcagaaaggtgcgaaaaaaggtgaaaggtattcttgtggatattgggcttgacagctgcaaggagttactgaaggaccttaaaggctttgatccaggagagaaatactttcataacacatcatggggtgatgtttctctctgggaaccttctggaaagaaagtgagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaaga

SEQ ID NO: 105639 - DNA, 880 bp, Homo sapiens
  Payload ID: 712
  Gene Symbol: ADNP2
  Gene Name: ADNP homeobox 2
  ENST ID: ENST00000560752
  CDS Start-End: 194-880
cgggaggaggggaccagtcgcgctgggggtgggcgcgcgctgaggcgggggtcccgccgcgcggggcggaggcgcgggcgggcgcaggcggccccacgggacgcggctgcgctcggcggaagacgcggcagccctgcgagaggcagcagcggagacgcggtgctcctcgggcgccaagcggaaaatttcaaaaatgtttcaaattcctgtggaaaatcttgacaacatcagaaaggaccttaaaggctttgatccaggagagaaatactttcataacacatcatggggtgatgtttctctctgggaaccttctggaaagaaagtgagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatt

SEQ ID NO: 105640 - DNA, 124 bp, Homo sapiens
  Payload ID: 712
  Gene Symbol: ADNP2
  Gene Name: ADNP homeobox 2
  ENST ID: ENST00000561195
  CDS Start-End: 1-80
atattgggcttgacagctgcaaggagttactgaagcccgacaggaagagtggagccctgcgctgtgtgcgtgcgttttaaagcgtgctggaaacgtctacaatggcagcgcagccagcagccac

SEQ ID NO: 105641 - DNA, 647 bp, Homo sapiens
  Payload ID: 712
  Gene Symbol: ADNP2
  Gene Name: ADNP homeobox 2
  ENST ID: ENST00000560561
  CDS Start-End: 1-247
tcttgtggatattgggcttgacagctgcaaggagttactgaaggaccttaaaggctttgatccaggagagaaatactttcataacacatcatggggtgatgtttctctctgggaaccttctggaaagaaagtgttgttagcaccttcctcggtatcagactcagctcatcccagacttgacttggctgtcccctctcaccagcttctgtggtcaaagtcatgctggccttgggaatttgggctttaagagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaa

SEQ ID NO: 105642 - DNA, 2557 bp, Homo sapiens
  Payload ID: 713
  Gene Symbol: ADPGK
  Gene Name: ADP-dependent glucokinase
  Uniprot ID: Q9BRR6
  ENST ID: ENST00000311669
  CDS Start-End: 95-1585
gtagcgcttgtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 105643 - DNA, 808 bp, Homo sapiens
  Payload ID: 713
  Gene Symbol: ADPGK
  Gene Name: ADP-dependent glucokinase
  Uniprot ID: Q9BRR6
  ENST ID: ENST00000456471
  CDS Start-End: 1-669
atggctgcaagctgcagggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaact

SEQ ID NO: 105644 - DNA, 951 bp, Homo sapiens
  Payload ID: 713
  Gene Symbol: ADPGK
  Gene Name: ADP-dependent glucokinase
  Uniprot ID: Q9BRR6
  ENST ID: ENST00000569517
  CDS Start-End: 25-261
cgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccggttcttctttgcggtccagttggtccaaagctacatgagcttcttgatgacaatgtctttgttccaccagagtcattgcaggaagtggatgagttccacctcattttagagtatcaagcaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctg

SEQ ID NO: 105645 - DNA, 514 bp, Homo sapiens
  Payload ID: 713
  Gene Symbol: ADPGK
  Gene Name: ADP-dependent glucokinase
  Uniprot ID: Q9BRR6
  ENST ID: ENST00000562823
  CDS Start-End: 40-276
aaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcttctttgcggtccagttggtccaaagctacatgagcttcttgatgacaatgtctttgttccaccagagtcattgcaggaag

SEQ ID NO: 105646 - DNA, 2262 bp, Homo sapiens
  Payload ID: 713
  Gene Symbol: ADPGK
  Gene Name: ADP-dependent glucokinase
  ENST ID: ENST00000569534
  CDS Start-End: 86-427
gtgtcgacatcggcgcgcgccgagcccggaagaggcgcgggctaggaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 105647 - DNA, 1041 bp, Homo sapiens
  Payload ID: 713
  Gene Symbol: ADPGK
  Gene Name: ADP-dependent glucokinase
  ENST ID: ENST00000563907
  CDS Start-End: 1-613
ggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtgggagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattgg

SEQ ID NO: 105648 - DNA, 556 bp, Homo sapiens
  Payload ID: 713
  Gene Symbol: ADPGK
  Gene Name: ADP-dependent glucokinase
  ENST ID: ENST00000562286
  CDS Start-End: 1-174
ctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccgcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttaga

SEQ ID NO: 105649 - DNA, 795 bp, Homo sapiens
  Payload ID: 713
  Gene Symbol: ADPGK
  Gene Name: ADP-dependent glucokinase
  ENST ID: ENST00000565814
  CDS Start-End: 332-795
gaaatatttcaagagggactgtggcaccaagacagtgaatgcctgcccctgagccccgatgagaaggaattaagggccctgtgactctgtatgtgaccagaagccacatcaggctccgccaggcctggcaactgtccctggtgttctgttcttcacctcctgcggctcctgactcttcagttctcagttggaattgagagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagag

SEQ ID NO: 105650 - DNA, 1820 bp, Homo sapiens
  Payload ID: 713
  Gene Symbol: ADPGK
  Gene Name: ADP-dependent glucokinase
  ENST ID: ENST00000569693
  CDS Start-End: 1-80
ggaagagactcttggaggtcctggcctcccagggacatatcttggcagctggctgtggagcttgcctcctgctgcagtgaggcacctcactgtatcccttcagatgtgggcagcagcttgagtaggacagggcagaacatcttcttgcctgagcctctgcatcctgtgctaaaccgaccatggctgcaagctgcagggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 105651 - DNA, 2716 bp, Homo sapiens
  Payload ID: 713
  Gene Symbol: ADPGK
  Gene Name: ADP-dependent glucokinase
  Uniprot ID: Q9BRR6
  ENST ID: ENST00000567941
  CDS Start-End: 41-277
gaaaggagttggttcgcgcaggtgcggcgcctgggtccccatggcgctgtggcgcggctccgcgtacgcgggcttcctggcgctggccgtgggctgcgtcttcctgctggagccagagctgccaggctcggcgctgcgctctctctggagctcgctgtgtctggggcccgcgcctgcgcccccgggacccgtctcccccgagggccggttggcggcagcctgggacgcgcttatcgtgcggccagtccggcgctggcgccgcgtggcagtggggtgagtgccaacggggcctgggtctctgagcctccgaggtcggccttggaggtcgggcggagccgcgcagaaacagggcttctcagaggtccccgggaggcgctgctgtccgcgctggccccttggcgagaagtgtcggacgtctgagtggaacccggttcgtcaccgctgctctttccactcggctggcctctgcgcctttctctcatcccgagtcaatgcatgtgttgatgtggtgctctcaggggtgaagctcttgcaggcacttggccttagtcctgggaatgggaaagatcacagcattctgcattcaaggaatgatctggaagaagccttcattcacttcatggggaagggagcagctgctgagcgcttcttcagtgataaggaaacttttcacgacattgcccaggttgcatcagagttcccaggagcccagcactatgtaggaggaaatgcagctttaattggacagaaatttgcagccaactcagatttaaaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 105652 - DNA, 1209 bp, Homo sapiens
  Payload ID: 714
  Gene Symbol: ADPRM
  Gene Name: ADP-ribose/CDP-alcohol diphosphatase, manganese-dependent
  Uniprot ID: Q3LIE5
  ENST ID: ENST00000379774
  CDS Start-End: 92-1120
gtccgtcccgctcgttggtggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttagtctaatttattttaacttgatagaaaatgagctttgtgtttgtccctcctaaacaaaaaaataaaaatcctctgtctcattgtttagta

SEQ ID NO: 105653 - DNA, 1277 bp, Homo sapiens
  Payload ID: 714
  Gene Symbol: ADPRM
  Gene Name: ADP-ribose/CDP-alcohol diphosphatase, manganese-dependent
  Uniprot ID: Q3LIE5
  ENST ID: ENST00000468843
  CDS Start-End: 72-689
gcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggtgaattattcctttgagctgagaatctaatagattgtctttaaattcttcagctaccttttattcagcaggaagatggacaattaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttagtctaatttattttaacttgatagaaaatgagctttgtgtttgtccctcctaaacaaaaaaataaaaatcctctgtctcattgtttagta

SEQ ID NO: 105654 - DNA, 1138 bp, Homo sapiens
  Payload ID: 714
  Gene Symbol: ADPRM
  Gene Name: ADP-ribose/CDP-alcohol diphosphatase, manganese-dependent
  ENST ID: ENST00000609540
  CDS Start-End: 28-912
ctttatttagaaacctgtttggaggttatggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttagtctaatttattttaacttgatagaaaatgagctttgtgtttgtccctcctaaacaaaaaaataaaaatcctctgtctcattgttta

SEQ ID NO: 105655 - DNA, 3439 bp, Homo sapiens
  Payload ID: 715
  Gene Symbol: ADPRH
  Gene Name: ADP-ribosylarginine hydrolase
  Uniprot ID: P54922
  ENST ID: ENST00000357003
  CDS Start-End: 299-1372
caggtgcgggggccctcgccgccaccctgcttatctggggacagtcccggaacccggtgacccggctccgccccaacccgcgccctcgtccacccgcagcagccaaggcctcttccccggccccgggagcccgcgccacgcccgtcgctcgcgcgttccagtccaggctacagcaggggctctccagcctgcattccatggccaacagcagtgcagctgcagaagcacttctggaagcctcctgacttgaactagaccttggacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagaaaaccacagaactatgactctcatgatttttcctttgtgaaatccctggttttcagctggaagcggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgta

SEQ ID NO: 105656 - DNA, 1365 bp, Homo sapiens
  Payload ID: 715
  Gene Symbol: ADPRH
  Gene Name: ADP-ribosylarginine hydrolase
  Uniprot ID: P54922
  ENST ID: ENST00000465513
  CDS Start-End: 106-1179
agagtcgttgttttttctgattcttcttgctcctcatcctatttcctttgtcttaatttccccacaaagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatccctt

SEQ ID NO: 105657 - DNA, 1501 bp, Homo sapiens
  Payload ID: 715
  Gene Symbol: ADPRH
  Gene Name: ADP-ribosylarginine hydrolase
  Uniprot ID: P54922
  ENST ID: ENST00000478927
  CDS Start-End: 299-1372
actctcgcttgggtgcagaagggcgcggcggtgccaggaagccgccttggaggctccaagattagctcactcagcgcggccaagcgcaggtgcgggggccctcgccgccaccctgcttatctggggacagtcccggaacccggtgacccggctccgccccaacccgcgccctcgtccacccgcagcagccaaggcctcttccccggccccgggagcccgcgccacgcccgtcgctcgcgcgttccagtccaggctacagcagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtccctt

SEQ ID NO: 105658 - DNA, 984 bp, Homo sapiens
  Payload ID: 715
  Gene Symbol: ADPRH
  Gene Name: ADP-ribosylarginine hydrolase
  ENST ID: ENST00000481816
  CDS Start-End: 608-984
aaagtcggacgtgagcacgggcgaaggcgtcagccggggccacacgggagtcactgaccacagccaggcgagagccggctttccggtgccgccacattccgggcaccaggctccgggctcttcagagcatttggggcgggcgacggaggtcccgtccactctcgcttgggtgcagaagggcgcggcggtgccaggaagccgccttggaggctccaagattagctcactcagcgcggccaagcgcaggtgcgggggccctcgccgccaccctgcttatctggggacagtcccggaacccggtgacccggctccgccccaacccgcgccctcgtccacccgcagcagccaaggcctcttccccggccccgggagcccgcgccacgcccgtcgctcgcgcgttccagtccaggctacagcagaaactcagcattaccagtaactgggtagtggaacgcatccatcttcgtcgtttactccttctccaggggctctccagcctgcattccatggccaacagcagtgcagctgcagaagcacttctggaagcctcctgacttgaactagaccttggacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatga

SEQ ID NO: 105659 - DNA, 4546 bp, Homo sapiens
  Payload ID: 715
  Gene Symbol: ADPRH
  Gene Name: ADP-ribosylarginine hydrolase
  Uniprot ID: P54922
  ENST ID: ENST00000478399
  CDS Start-End: 1406-2479
aaataaatgactagttaaaattaactaactgaatccttaacaaccattctaagaggcagatattattatcccactttatgcgtgagggcccagaaccctggcaagggcggcacactcagtacgctcttcaagcatctgggcacacccggtccactacagtcctacaaagtcggacgtgagcacgggcgaaggcgtcagccggggccacacgggagtcactgaccacagccaggcgagagccggctttccggtgccgccacattccgggcaccaggctccgggctcttcagagcatttggggcgggcgacggaggtcccgtccactctcgcttgggtgcagaagggcgcggcggtgccaggaagccgccttggaggctccaagattagctcactcagcgcggccaagcgcaggtgcgggggccctcgccgccaccctgcttatctggggacagtcccggaacccggtgacccggctccgccccaacccgcgccctcgtccacccgcagcagccaaggcctcttccccggccccgggagcccgcgccacgcccgtcgctcgcgcgttccagtccaggctacagcaggtatcgcgatcccggccctcggccccgcgctcccctcccccgcccctggcgctctccgagtgtggccgaccatgaggattcccagtcttgcaaatcgtgggagcgtgtcaaccgccccgtttctttccaaagccgggcatggcccggaagcagctgatcagatcttagttctgaatgtatagttcgggtacgagaatgtgacccgtgaaagttcagaggagttaagtaattacagcgttctgaaagcgaacgttaaagggaatttacaaccgaaaaaagatgccggtcttcttcccccatcccagcttgcaattcacagaagcacacattagggtggagccagaaggaattacggaaaggacaatgaggacattgagagggagggtatggggggttaaagttagtcctccgaggccaagaagcagagtgtcttggcctagtgtctgaaaatcgcagcgcaggacggaacttccgagagcctatacctccccacttccccctccagtttacagatgggcaaaccgctgtcccgggtgtctgtcaggtctagtagcccagaatctcagtgcctaggcttcactgtaaataataaactatgtaaataacatttacaaatatcctttgtgagctcagaaactcagcattaccagtaactgggtagtggaacgcatccatcttcgtcgtttactccttctccaggggctctccagcctgcattccatggccaacagcagtgcagctgcagaagcacttctggaagcctcctgacttgaactagaccttggacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaacagaacctagcacagtgcttgggcagccaataggcattaatcagtatctattgagtgttatgaactagcctcctagctcgtgcttccctcattaccctccagagttatgtttacgaataacaaattgaccatgctaaactaatcatgttccaatgaatacatcacctttcttcatttcttgatgctcttcccaatccttgtctacctgataataaattcttacttgtccttcaagacccaactcagatagatagagcttcctgagtgaaacctgctttgattgttcaggcacttggccaccttctcctcactcctcccacagccttctgtcttggccttgtcatcacatcaatcctgttgtgtggtgctgtgtgtcttctgggtcagtcctaggcacatgctgcccagcacatgtccacctgggaaatgagatgccatcgtcacattcatttggtcaccctcagtccagccagtgggcttgctctcatttggcctgttctcaggggtgggaaggaagagcgtcccttccttctccttttgagaaaaccacagaactatgactctcatgatttttcctttgtgaaatccctggttttcagctggaagcggtgggtaaatgaggtctgatgatagcagtcctgccaccttctagttcatcccataggaatgtttttccaagtccttccagtctttttagaacgtggtggaggagggttgtgtgtgccccagggggtcgggggtaggggatgcagggaggatcttagcatttgttgttttctagtgcagggctttagccacaattgtaaacaacaggaaaaggctctttagagatcctattagatttgctttgccgattgtcactcttcatcacaggcacatttcaaaaagaggttagactttcagacttcttttttctcaaacctcaaaacttccaccccaaacttcgctctcagctggtgactttgcttctttatgtgtgtgtatgtgtgtcagagaaagagagagagagagagagaagggaggatgagaacgaatggggggaagagataaactttatgcataacattagggtaaatcaataaagatggtctgacacatcgta

SEQ ID NO: 105660 - DNA, 1888 bp, Homo sapiens
  Payload ID: 716
  Gene Symbol: ARF1
  Gene Name: ADP-ribosylation factor 1
  Uniprot ID: P84077
  ENST ID: ENST00000272102
  CDS Start-End: 144-689
ccttacccggcgtgccccgcgcccggaggcgctgacgtggccgccgtcagagccgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttca

SEQ ID NO: 105661 - DNA, 2006 bp, Homo sapiens
  Payload ID: 716
  Gene Symbol: ARF1
  Gene Name: ADP-ribosylation factor 1
  Uniprot ID: P84077
  ENST ID: ENST00000541182
  CDS Start-End: 263-808
gcccgcgcgtggacggttgggattagcggccgcgggggccggtgggggtcgtggggcctcccccacccgagtacaggcgagcgagcggcatccgggcggacccccgcctcggggaccgggaaactgaggctcgggcggcctgagacgccgtcaaggtcatgtaggtggtgggggcttgcatcttcgcctcccgactccatccagttcgtgtttgctgtgaagacggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttc

SEQ ID NO: 105662 - DNA, 1972 bp, Homo sapiens
  Payload ID: 716
  Gene Symbol: ARF1
  Gene Name: ADP-ribosylation factor 1
  Uniprot ID: P84077
  ENST ID: ENST00000540651
  CDS Start-End: 229-774
ccttacccggcgtgccccgcgcccggaggcgctgacgtggccgccgtcagagccgccatcttgtgggagcaaaaccaacgcctggctcggagcagcagcctctgaggtgagggcgaggggcgcgggccggtgtgggccgcagagacgttggagccggcgggggctggggactggcctcggggcgacttgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttc

SEQ ID NO: 105663 - DNA, 4105 bp, Homo sapiens
  Payload ID: 717
  Gene Symbol: ARF3
  Gene Name: ADP-ribosylation factor 3
  Uniprot ID: P61204
  ENST ID: ENST00000256682
  CDS Start-End: 336-881
accgcgcagctatcgcgcgatcggggaggtgggaagtatcccgggctgggggtgggggtacgccgcacagctccagtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtc

SEQ ID NO: 105664 - DNA, 1089 bp, Homo sapiens
  Payload ID: 717
  Gene Symbol: ARF3
  Gene Name: ADP-ribosylation factor 3
  Uniprot ID: P61204
  ENST ID: ENST00000447318
  CDS Start-End: 262-696
agtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttg

SEQ ID NO: 105665 - DNA, 576 bp, Homo sapiens
  Payload ID: 717
  Gene Symbol: ARF3
  Gene Name: ADP-ribosylation factor 3
  ENST ID: ENST00000539611
  CDS Start-End: 425-576
agagggagcggagcggaacctgcggggcagaggcggcggccgcagcggcgcagctgatagcaggaacagttttattgggaggagatctgctgcaagagtctgattgcttgggtcagtgcaacaggacagaatctagtcgctgcatacctccttccctgtcctcaatcagaacctgtgggctctgaggacatggaaaccatttcttcagtttgtcagatacagggaaaaggatcagagaccacctatagaatacagtcttcttcaaccccacaagtgttttgccaccctcagtagaaccgttctcaacacgcctgtcagtcactagctataggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggtt

SEQ ID NO: 105666 - DNA, 485 bp, Homo sapiens
  Payload ID: 717
  Gene Symbol: ARF3
  Gene Name: ADP-ribosylation factor 3
  ENST ID: ENST00000541236
  CDS Start-End: 179-485
gctcaagggggcgacctgggctgcagttaggttgtcgcctgcaggaggtgtgctgttgagggagaggaaaaccgtccgaggagaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgagg

SEQ ID NO: 105667 - DNA, 807 bp, Homo sapiens
  Payload ID: 717
  Gene Symbol: ARF3
  Gene Name: ADP-ribosylation factor 3
  Uniprot ID: P61204
  ENST ID: ENST00000541959
  CDS Start-End: 240-785
gggaaggaaggagggagccggggagtgggccagggcagcagccgggctgaagtcggcttggggagccagagggagcggagcggaacctgcggggcagaggcggcggccgcagcggcgcagctgatagcaggaacagaagtctcagggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaag

SEQ ID NO: 105668 - DNA, 557 bp, Homo sapiens
  Payload ID: 717
  Gene Symbol: ARF3
  Gene Name: ADP-ribosylation factor 3
  ENST ID: ENST00000545855
  CDS Start-End: 437-557
aaaacgggccacttgattagcaaagtggtagctgttattttgggggaattcccgtcttgattgcattaaggcgggtctccatctttccaggccaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactcgggg

SEQ ID NO: 105669 - DNA, 1660 bp, Homo sapiens
  Payload ID: 718
  Gene Symbol: ARF4
  Gene Name: ADP-ribosylation factor 4
  Uniprot ID: P18085
  ENST ID: ENST00000303436
  CDS Start-End: 269-811
gccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaattattcctaataaaatgataaaatacgtaa

SEQ ID NO: 105670 - DNA, 1467 bp, Homo sapiens
  Payload ID: 718
  Gene Symbol: ARF4
  Gene Name: ADP-ribosylation factor 4
  ENST ID: ENST00000496292
  CDS Start-End: 186-647
taccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatgggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatttggaat

SEQ ID NO: 105671 - DNA, 732 bp, Homo sapiens
  Payload ID: 718
  Gene Symbol: ARF4
  Gene Name: ADP-ribosylation factor 4
  ENST ID: ENST00000488156
  CDS Start-End: 666-732
ctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcgtaccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatgg

SEQ ID NO: 105672 - DNA, 641 bp, Homo sapiens
  Payload ID: 718
  Gene Symbol: ARF4
  Gene Name: ADP-ribosylation factor 4
  ENST ID: ENST00000463880
  CDS Start-End: 261-641
gcgcaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaa

SEQ ID NO: 105673 - DNA, 1601 bp, Homo sapiens
  Payload ID: 718
  Gene Symbol: ARF4
  Gene Name: ADP-ribosylation factor 4
  ENST ID: ENST00000486310
  CDS Start-End: 227-406
ctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattgcggtcatttttgtttttctttgtaggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcata

SEQ ID NO: 105674 - DNA, 1360 bp, Homo sapiens
  Payload ID: 718
  Gene Symbol: ARF4
  Gene Name: ADP-ribosylation factor 4
  ENST ID: ENST00000489843
  CDS Start-End: 331-546
caggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaattggatatctaaccaaggacatgtttgataaaattggtctaggcttgttacaacaaaattagtttgtatcttggttattaaacagtatctgggactggtttgggcagaatattaaacttattttgttgccaattattgtttaccgagtataatgttgctatttagcaatgtgcttggttttaaagaaattctccttgggaaaaaagtatcctcttttaattttacttcccataagcgtaaatgcctggacatagctcttgtgcaacctttaaataaattgttttgagtgttttttgagccccagacaaataatgttttaaagttatccccttgctactttactgatacctttatcattcctgagacagtttgctaatttaaaaatgtagcattccatttgtatttatttctctcccttgccaaaaagattttctaatactgcttgtaccagccagagaaagatccaaaacactactcagctctcttgcactgaggaaatttttccccctacattgactcctggcctacatcagccaaacttaaccttggtggggtttggatttgatagccaattagttctgtgctggttgcaaagaattgatatttagatggtttttaatactcagcagattgtcttcctttatattgtgtcttttttatgttgcatgttgcttttgttatcagcctgattttttgctcagtatatgatagttctgctgatgttttgtttattgggcagacatatcttcattaagagtttttggaaaactcatcaaattcgatgaatacattttcttcataacccatt

SEQ ID NO: 105675 - DNA, 1103 bp, Homo sapiens
  Payload ID: 719
  Gene Symbol: ARF5
  Gene Name: ADP-ribosylation factor 5
  Uniprot ID: P84085
  ENST ID: ENST00000000233
  CDS Start-End: 155-697
acgggggcgggcccgcggtgacgtcgggagggcagcgacgcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacacgg

SEQ ID NO: 105676 - DNA, 546 bp, Homo sapiens
  Payload ID: 719
  Gene Symbol: ARF5
  Gene Name: ADP-ribosylation factor 5
  ENST ID: ENST00000415666
  CDS Start-End: 97-546
gcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatggaggacgagctgcgggatgcagtgctgctggtatttgccaacaagcaggacatgcccaacgccatgcccgtgagcgagctgactgacaagctggggctacagcacttacgcagccgcacg

SEQ ID NO: 105677 - DNA, 3865 bp, Homo sapiens
  Payload ID: 720
  Gene Symbol: ARF6
  Gene Name: ADP-ribosylation factor 6
  Uniprot ID: P62330
  ENST ID: ENST00000298316
  CDS Start-End: 548-1075
cggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggatttttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtgca

SEQ ID NO: 105678 - DNA, 2776 bp, Homo sapiens
  Payload ID: 721
  Gene Symbol: ARFGAP1
  Gene Name: ADP-ribosylation factor GTPase activating protein 1
  Uniprot ID: Q8N6T3
  ENST ID: ENST00000353546
  CDS Start-End: 61-1305
cggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaagttttggggtcacaagcagcagccggagccggcgtccgagctgggccacagcctgaacgagaacgtcctcaagcctgcgcaggagaaggtgaaggagggaaagatttttgatgatgtctccagtggggtctctcagttggcgtccaagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgt

SEQ ID NO: 105679 - DNA, 3467 bp, Homo sapiens
  Payload ID: 721
  Gene Symbol: ARFGAP1
  Gene Name: ADP-ribosylation factor GTPase activating protein 1
  Uniprot ID: Q8N6T3
  ENST ID: ENST00000370275
  CDS Start-End: 93-1304
gggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaagtgccagcgccgtctttgctgccatcagtcccactgctctgcgggccatttggggcgtgcattttgtcctgtttcctggcatgaggcgctctgcggacagacggggagggaagagcaggcctcgctcctcccccccaagcatgtggtgggagctcttgaggtctgtgcacgaggctgtcctcgctgccatgtcccgcacacacctggcaccgctgcagagtggccggggcgtctgtgtctgtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatg

SEQ ID NO: 105680 - DNA, 3281 bp, Homo sapiens
  Payload ID: 721
  Gene Symbol: ARFGAP1
  Gene Name: ADP-ribosylation factor GTPase activating protein 1
  Uniprot ID: Q8N6T3
  ENST ID: ENST00000370283
  CDS Start-End: 141-1361
gtgagaccttgcaaagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcagaa

SEQ ID NO: 105681 - DNA, 1548 bp, Homo sapiens
  Payload ID: 721
  Gene Symbol: ARFGAP1
  Gene Name: ADP-ribosylation factor GTPase activating protein 1
  ENST ID: ENST00000520485
  CDS Start-End: 110-502
agctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataagagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgt

SEQ ID NO: 105682 - DNA, 579 bp, Homo sapiens
  Payload ID: 721
  Gene Symbol: ARFGAP1
  Gene Name: ADP-ribosylation factor GTPase activating protein 1
  ENST ID: ENST00000523114
  CDS Start-End: 342-579
gcaaagcgcaacgtagccggaagctggtggcggctggtgggcgaccgggcgcatcctcattgcagtgcggcggccctacctcggccctggcctgaccccggcggccctgcccgcccctccctccagtcggctgtataggtggatgctcagtttgatgacggtatccgcctgaatgagtcatgctgggggtccaagtcctgcggtcaggagtgagcattcagatgtctgcctcatgatctgtggttcctggacactcttacagaaggcacagaattatggagcagaagggagcccagggtgaacttttggttttgttttgatgaactgcagaaaacagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtggga

SEQ ID NO: 105683 - DNA, 905 bp, Homo sapiens
  Payload ID: 721
  Gene Symbol: ARFGAP1
  Gene Name: ADP-ribosylation factor GTPase activating protein 1
  ENST ID: ENST00000518601
  CDS Start-End: 174-905
gcggccctacctcggccctggcctgaccccggcggccctgcccgcccctccctccagcatcatggccagcccaagaaccaggaaggttcttaaagaagtcagggtgcaggatgagaacaacctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgacggagtcttgctttgtcgcccaggctgcagactggagggcagtggtgcgacctcagctcactgcaacctctgcctcccaggttcagggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggac

SEQ ID NO: 105684 - DNA, 572 bp, Homo sapiens
  Payload ID: 721
  Gene Symbol: ARFGAP1
  Gene Name: ADP-ribosylation factor GTPase activating protein 1
  ENST ID: ENST00000523460
  CDS Start-End: 113-572
ggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactg

SEQ ID NO: 105685 - DNA, 3191 bp, Homo sapiens
  Payload ID: 721
  Gene Symbol: ARFGAP1
  Gene Name: ADP-ribosylation factor GTPase activating protein 1
  Uniprot ID: Q8N6T3
  ENST ID: ENST00000519604
  CDS Start-End: 190-1275
gtgagaccttgcaaagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaagttttggggtcacaagcagcagccggagccggcgtccgagctgggccacagcctgaacgagaacgtcctcaagcctgcgcaggagaaggtgaaggagggaaagatttttgatgatgtctccagtggggtctctcagttggcgtccaagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgc

SEQ ID NO: 105686 - DNA, 995 bp, Homo sapiens
  Payload ID: 721
  Gene Symbol: ARFGAP1
  Gene Name: ADP-ribosylation factor GTPase activating protein 1
  ENST ID: ENST00000522403
  CDS Start-End: 212-995
acccgcaccccggatctggaatctcccaccggttacgggagtccagagggtccctgcccacgcacgtcgcctcccggggcgcgagcaggaccctgccccgtccgcttcaacacccttttcccgagctccttcggacccaggactcggcctggacacatcccagtcaggtggcctctgaagcccggtggggcttccaccccctaagaacatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagg

SEQ ID NO: 105687 - DNA, 3176 bp, Homo sapiens
  Payload ID: 721
  Gene Symbol: ARFGAP1
  Gene Name: ADP-ribosylation factor GTPase activating protein 1
  Uniprot ID: Q8N6T3
  ENST ID: ENST00000519273
  CDS Start-End: 379-1260
gtgagaccttgcaaagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataagagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgc

SEQ ID NO: 105688 - DNA, 1040 bp, Homo sapiens
  Payload ID: 721
  Gene Symbol: ARFGAP1
  Gene Name: ADP-ribosylation factor GTPase activating protein 1
  ENST ID: ENST00000549047
  CDS Start-End: 227-1040
ccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagca

SEQ ID NO: 105689 - DNA, 572 bp, Homo sapiens
  Payload ID: 721
  Gene Symbol: ARFGAP1
  Gene Name: ADP-ribosylation factor GTPase activating protein 1
  ENST ID: ENST00000550188
  CDS Start-End: 206-572
cttttcccgagctccttcggacccaggactcggcctggacacatcccagtcaggtggcctctgaagcccggtggggcttccaccccctaagaagtgagggtcctaagaaggagatatatttttacatcttggtttcaagcgttcagagtttttgcgttatttttcaagataaactatatttgtacttttgaaggttaggagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagag

SEQ ID NO: 105690 - DNA, 1327 bp, Homo sapiens
  Payload ID: 721
  Gene Symbol: ARFGAP1
  Gene Name: ADP-ribosylation factor GTPase activating protein 1
  ENST ID: ENST00000547204
  CDS Start-End: 241-1263
aaagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaagttttggggtcacaagcagcagccggagccggcgtccgagctgggccacagcctgaacgagaacgtcctcaagcctgcgcaggagaaggtgaaggagggaaagatttttgatgatgtctccagtggggtctctcagttggcgtccaagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcg

SEQ ID NO: 105691 - DNA, 913 bp, Homo sapiens
  Payload ID: 721
  Gene Symbol: ARFGAP1
  Gene Name: ADP-ribosylation factor GTPase activating protein 1
  ENST ID: ENST00000549076
  CDS Start-End: 1-314
ctgagcccaccaagacccgcaagtccccgagcagcgacagctggacgtgcgcggacacctccaccgagaggaggagctcggacagctgggagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagc

SEQ ID NO: 105692 - DNA, 2937 bp, Homo sapiens
  Payload ID: 722
  Gene Symbol: ARFGAP2
  Gene Name: ADP-ribosylation factor GTPase activating protein 2
  ENST ID: ENST00000426335
  CDS Start-End: 273-1754
actacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaagc

SEQ ID NO: 105693 - DNA, 556 bp, Homo sapiens
  Payload ID: 722
  Gene Symbol: ARFGAP2
  Gene Name: ADP-ribosylation factor GTPase activating protein 2
  ENST ID: ENST00000529439
  CDS Start-End: 1-51
aaggtgcgtgagcagggggcgcgcggagtctctcgtcccgctggggcctgagggagggagaagggcggaggtgggttatgtttctggggtgtcggtgcctggcctttactcggggcccctgacgattcgctcatcgccgcctccacccaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatccccctgcctgggatgcgccagccactgagccttcagggacccagcagccagccccgtctacagagagcagtggcctggcac

SEQ ID NO: 105694 - DNA, 730 bp, Homo sapiens
  Payload ID: 722
  Gene Symbol: ARFGAP2
  Gene Name: ADP-ribosylation factor GTPase activating protein 2
  ENST ID: ENST00000528444
  CDS Start-End: 15-730
gggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaagtgcttgtaggtcttggtgcttcttgccagcaggagtggctcaccgaggcatctgtgatctggcctccttttcagccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattgg

SEQ ID NO: 105695 - DNA, 550 bp, Homo sapiens
  Payload ID: 722
  Gene Symbol: ARFGAP2
  Gene Name: ADP-ribosylation factor GTPase activating protein 2
  ENST ID: ENST00000528708
  CDS Start-End: 1-54
aacaaggtgcgtgagcagggggcgcgcggagtctctcgtcccgctggggcctgagggagggagaagggcggaggtgggttatgtttctggggtgtcggtgcctggcctttactcggggcccctgacgattcgctcatcgccgcctccacccaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacag

SEQ ID NO: 105696 - DNA, 1000 bp, Homo sapiens
  Payload ID: 722
  Gene Symbol: ARFGAP2
  Gene Name: ADP-ribosylation factor GTPase activating protein 2
  ENST ID: ENST00000525398
  CDS Start-End: 18-1000
tctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaagagtggctcaccgaggcatctgtgatctggcctccttttcagccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaag

SEQ ID NO: 105697 - DNA, 740 bp, Homo sapiens
  Payload ID: 722
  Gene Symbol: ARFGAP2
  Gene Name: ADP-ribosylation factor GTPase activating protein 2
  ENST ID: ENST00000532438
  CDS Start-End: 27-296
gcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaa

SEQ ID NO: 105698 - DNA, 548 bp, Homo sapiens
  Payload ID: 722
  Gene Symbol: ARFGAP2
  Gene Name: ADP-ribosylation factor GTPase activating protein 2
  ENST ID: ENST00000524586
  CDS Start-End: 15-299
gggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgataataacttcgctgtcataaggagatgtctcctacagccaacacgtttccttcttgagaatcacccgtagcacgcgctgctctcttctttgctctccagacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatca

SEQ ID NO: 105699 - DNA, 1558 bp, Homo sapiens
  Payload ID: 722
  Gene Symbol: ARFGAP2
  Gene Name: ADP-ribosylation factor GTPase activating protein 2
  ENST ID: ENST00000533243
  CDS Start-End: 273-485
actacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcagctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactga

SEQ ID NO: 105700 - DNA, 709 bp, Homo sapiens
  Payload ID: 722
  Gene Symbol: ARFGAP2
  Gene Name: ADP-ribosylation factor GTPase activating protein 2
  ENST ID: ENST00000527776
  CDS Start-End: 1-709
ggtcgcctccatgcgtctggcctaccaggagctccagattgatcgtaagaaagaggaaaagaagctacagaatctggaagggaagaagcgagagcaggcagaaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcag

SEQ ID NO: 105701 - DNA, 850 bp, Homo sapiens
  Payload ID: 722
  Gene Symbol: ARFGAP2
  Gene Name: ADP-ribosylation factor GTPase activating protein 2
  ENST ID: ENST00000527927
  CDS Start-End: 28-850
cgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggaga

SEQ ID NO: 105702 - DNA, 2976 bp, Homo sapiens
  Payload ID: 722
  Gene Symbol: ARFGAP2
  Gene Name: ADP-ribosylation factor GTPase activating protein 2
  Uniprot ID: Q8N6H7
  ENST ID: ENST00000524782
  CDS Start-End: 230-1795
cccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaa

SEQ ID NO: 105703 - DNA, 840 bp, Homo sapiens
  Payload ID: 722
  Gene Symbol: ARFGAP2
  Gene Name: ADP-ribosylation factor GTPase activating protein 2
  ENST ID: ENST00000529455
  CDS Start-End: 1-400
ggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgataactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggaccc

SEQ ID NO: 105704 - DNA, 785 bp, Homo sapiens
  Payload ID: 722
  Gene Symbol: ARFGAP2
  Gene Name: ADP-ribosylation factor GTPase activating protein 2
  ENST ID: ENST00000525314
  CDS Start-End: 30-785
gccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggagtccgtgtatctgtcagctaaaggggcccttcctgccagagaactgaaaagctccatcattggcaagaagaagccagcagcagctaagaaagggctgggtgccaagaaaggcctaggggcccagaaggtgagcagc

SEQ ID NO: 105705 - DNA, 534 bp, Homo sapiens
  Payload ID: 722
  Gene Symbol: ARFGAP2
  Gene Name: ADP-ribosylation factor GTPase activating protein 2
  ENST ID: ENST00000530596
  CDS Start-End: 16-534
tgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcagacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtct

SEQ ID NO: 105706 - DNA, 578 bp, Homo sapiens
  Payload ID: 722
  Gene Symbol: ARFGAP2
  Gene Name: ADP-ribosylation factor GTPase activating protein 2
  ENST ID: ENST00000528041
  CDS Start-End: 27-359
gcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcagacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaagagtggctcaccgaggcatctgtgatctggcctccttttcagccccctgcctgggatgcgccagccactgagccttcagggacccagcagccagccccgtctacagagagcagtggcctggcacagccggagcatggccccaaca

SEQ ID NO: 105707 - DNA, 940 bp, Homo sapiens
  Payload ID: 722
  Gene Symbol: ARFGAP2
  Gene Name: ADP-ribosylation factor GTPase activating protein 2
  ENST ID: ENST00000532478
  CDS Start-End: 1-360
cggagccgaacaagaccgaaatccagactctttttaagaggcttcgcgcagttccaaccaacaaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaag

SEQ ID NO: 105708 - DNA, 474 bp, Homo sapiens
  Payload ID: 722
  Gene Symbol: ARFGAP2
  Gene Name: ADP-ribosylation factor GTPase activating protein 2
  ENST ID: ENST00000526342
  CDS Start-End: 7-474
gagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtct

SEQ ID NO: 105709 - DNA, 213 bp, Homo sapiens
  Payload ID: 722
  Gene Symbol: ARFGAP2
  Gene Name: ADP-ribosylation factor GTPase activating protein 2
  ENST ID: ENST00000629231
  CDS Start-End: 1-213
atggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcagctgggtgccaagaaaggcctag

SEQ ID NO: 105710 - DNA, 2613 bp, Homo sapiens
  Payload ID: 722
  Gene Symbol: ARFGAP2
  Gene Name: ADP-ribosylation factor GTPase activating protein 2
  ENST ID: ENST00000627920
  CDS Start-End: 273-1430
actacgcgcgcgaggaggtttgggccggtccgcgcgccgtcgccccgccccggctgcggattggcccggcgcggcgttgattcttgcggccgcggttgtcgtcgccgcccccgtcccgccggctgcccattggtccagatcggactccaatcaccccacccctcggctggcccaggcaccgctgaggccggcctggtgagcccgccctccccgccgtggattggcccgcggcgggacccgtcagccgcggttgtgtctgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcagagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaagc

SEQ ID NO: 105711 - DNA, 2857 bp, Homo sapiens
  Payload ID: 723
  Gene Symbol: ARFGAP3
  Gene Name: ADP-ribosylation factor GTPase activating protein 3
  Uniprot ID: Q9NP61
  ENST ID: ENST00000263245
  CDS Start-End: 221-1771
gggccagcggcgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagggagaaaatcaaatcgctcgcctctcaagcaacacggaagcatggcactgatctgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcagatggcattgcctacatttttccctgaaa

SEQ ID NO: 105712 - DNA, 1650 bp, Homo sapiens
  Payload ID: 723
  Gene Symbol: ARFGAP3
  Gene Name: ADP-ribosylation factor GTPase activating protein 3
  Uniprot ID: Q9NP61
  ENST ID: ENST00000437119
  CDS Start-End: 58-1476
ttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcactgtggcttgatagttgtgtggttccacctttgtcccctccaccaaaggaggaagatttttttgcctctcacgtttctcctgaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgta

SEQ ID NO: 105713 - DNA, 542 bp, Homo sapiens
  Payload ID: 723
  Gene Symbol: ARFGAP3
  Gene Name: ADP-ribosylation factor GTPase activating protein 3
  ENST ID: ENST00000454099
  CDS Start-End: 87-542
ctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcagtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggc

SEQ ID NO: 105714 - DNA, 817 bp, Homo sapiens
  Payload ID: 723
  Gene Symbol: ARFGAP3
  Gene Name: ADP-ribosylation factor GTPase activating protein 3
  ENST ID: ENST00000453516
  CDS Start-End: 1-817
tctcgccttgtttcaggtgagtgacacagcgtgggcatcagcaatagcagaaccatcttctttaacatcaaggcctgtggaaaccactttggaaaataatgaaggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagca

SEQ ID NO: 105715 - DNA, 501 bp, Homo sapiens
  Payload ID: 723
  Gene Symbol: ARFGAP3
  Gene Name: ADP-ribosylation factor GTPase activating protein 3
  ENST ID: ENST00000435208
  CDS Start-End: 226-501
cctcaacccgcactgccatctctccatgaacgtgacacaaaagcccttggtttcagaaagccagtttccgggcaaagaaagctttccacccagggcctggcgtgagctgagggcaagaattaaaaagagtcgggcgcggcggctcacgtctgtaatcccagcaatttggaaggccgaagtgggtggatcacctgaagtcaggagttcgagaccagcctgggcaacatggtgtgttttgattgtggtgccaaaaatcccagctgggcaagcataacctatggagtgttcctttgcattgattgctcagggtcccaccggtcacttggtgttcacttgagttttattcgatctacagagttggattccaactggtcatggtttcagttgcgatgcatgcaagtcggaggaaacgctagtgcatcttccttttttcatcaacatgggtgttccaccaatgacaccaatgccaagtacaacagtcgtgctgctcagctctatagg

SEQ ID NO: 105716 - DNA, 7225 bp, Homo sapiens
  Payload ID: 724
  Gene Symbol: ARFGEF1
  Gene Name: ADP-ribosylation factor guanine nucleotide-exchange factor 1 (brefeldin A-inhibited)
  Uniprot ID: Q9Y6D6
  ENST ID: ENST00000262215
  CDS Start-End: 391-5940
gcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgaggtacggcttcttgggggcggcgaggacctcgacgcccttcgccgacaccgcggctggtcccgctcgcccgccccttcctgatcctgccgctgccctccacgcctccaatcccccacctccaccccctctcctttctctcttctcttccttcctctcctcctcctcccctccagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagatagtacaacaccaggcaaaaaattaattgatagaattattgaaacaatatgtggctgctttcagggccctcagacagatgaaggagttcagctgcagataataaaggctttacttactgcagtaacatcacaacacatagaaattcatgaagggactgtactgcaagctgtgagaacatgttacaatatctacttagcaagcaaaaatctcatcaatcagacaacagccaaagctactctcactcagatgctaaatgttatctttgcacgcatggaaaaccaagcattacaggaagcaaaacaaatggaaaaagaaaggcatcggcagcatcatcatctgttacagtctccagtaagccatcacgagcctgaatcacctcaacttagatatttgccacctcagactgttgatcatatatcccaagaacacgaaggggaccttgacctccatacaaatgatgtagataaaagtcttcaggatgacacagagcctgaaaatggatctgatatttccagtgcagaaaatgaacagactgaagctgatcaggcaactgcagctgaaacattatctaaaaatgaagtgttatatgacggagaaaaccatgattgtgaggaaaagccacaagacattgtacagaacattgtagaagaaatggtgaacattgttgttggagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggaatctggaaattcttcaggaccttcacctggtgctaagttttcccacattttacaaaaggatgcctttctagtattcaggtcattgtgtaaactgtcaatgaaaccactgtcagatggaccaccagatccaaagtctcatgaactacgatccaagattctttcattgcagttacttctatccattctgcagaatgcaggacctattttcaggacaaatgagatgtttattaatgctattaagcagtatctttgtgttgcactctcaaaaaatggagtctcatctgttccagaggtttttgagctttctctttctatatttcttactttgttgtcaaatttcaagacacatctgaagatgcaaattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatcaaaacctgtataa

SEQ ID NO: 105717 - DNA, 5882 bp, Homo sapiens
  Payload ID: 724
  Gene Symbol: ARFGEF1
  Gene Name: ADP-ribosylation factor guanine nucleotide-exchange factor 1 (brefeldin A-inhibited)
  ENST ID: ENST00000520381
  CDS Start-End: 1-3838
aattgaggtgttctttaaagaaattttcttatacattttggaaacttctaccagctcatttgatcacaaatggatggttattcagacactgacgaggatttgtgcagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggaattgagcctgaggaaaaaaggtttagaatgcttagtgtcgattttgaagtgtatggttgaatggagtaaggatcagtatgtgaatcccaactcccagacaactcttggtcaggaaaaaccctcagagcaagagatgagtgaaatcaaacaccctgagacaataaacagatacggaagtttaaattccctggagtcaacatcatcatcaggaataggcagctacagtacacagatgtctggcactgataatccagaacaatttgaggtcctaaagcaacaaaaagaaataatagaacaagggatagatttatttaataagaaaccaaagagaggaatacagtacctccaagaacaagggatgcttggcaccacacctgaagatattgcccaattcttacatcaagaggaaagattagactctactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaaggacaaactctctttgctagtgcggatacagcttatgttttggcttattcaattatcatgttgaccacagaccttcacagtccacaggtgaaaaataaaatgacaaaggaacaatacattaagatgaatagaggtatcaatgacagtaaagaccttcctgaagagtatctatcagccatctataatgaaatagctgggaaaaagatatcaatgaaagaaacaaaagaactaacaatccctacaaaatcaagtaaacagaatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaagttggcttggacgccttttctggctgcattcagtgtgggtctacaagattgtgatgatactgaagtagcctctctttgcctggaaggtataagatgtgcaatcagaattgcatgcattttcagcattcagctggagagagatgcatatgtccaggcactagcaagatttaccttactcacagtgagttccggtattactgaaatgaaacagaagaacattgacacaataaaaacacttatcacagtggctcatacagatggaaattatttaggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggaccaaacggaccctgtgagcatggggctgccagtgaaaggaggatgcctgggaatgaaatcaatagaagagatgcagaaagcctacggaaaaacagcgtgctgatactatttgacacagcaatgattatttcttacctttggcaccttcctgcatttttattctgttcagcctcttctgctgctctcttagcagggcttgctgctgaatctctaaggtgtgatgatctcttggaggatccaggtacataaatttcagatcaactcgtgtttctgaatctggtataaaaaatatgttatataactaagttaaatgttgttttcaaatgggattttgtaaaacttcactgtaagtaacatgagtaacctaatttcaaaatcaaggaaatgatagaaatagtgaaacatcactaaagtcaaaggacagtaaaatagccacaaaactaaagaatatgaaattaatattctttaataagtgtcttttcacaaacttaccaacataaggaataccccagaacaagcagtggatgttgcattgtccatctctacctgtcctagccctgccaggatgccacccagaacacagactacgtgcaggtatatccaagcagatggtcacatggctatgactaaggcagccatgagacactgtaatcacggctgatctctaaaatatactggaaacgtgaaaaaataatgttactggccaattaatattttagtccttacaaatatcatgcagaaagcaagataaatgtagactggctggaacttgagggggaatgccatttctttttttttttttttcttgagacggagtcttgctctgtcgcccaggctggagtgcagtggcacggtcttggctcactgccagctctgcctcctgggttcatgccattctcctgcctcagtctcccaagtagctgggactacaagcacccaccactatgcccggctaatttttcttgtagtttttagtagagacgaggtttcactatgttggccaggctggtcttgaactcctgacctcgtgatccacacgcctcggcctctcaaagtgctgggattacaggcattagccactgtgcctggccaagaataaaaattttttaatcttgagaagaaacatacagttcatacatataaaaagccttgaaaatattattccctttgactcactaattacactgctggaatataaagaaatgatcctaaatatatatgtagttttatggtcctaaatatgtataaagctttatgatcagaaattatcaaaagaacaaaatagtgaaaatggttaacagccattttcagaagttaacagaagtttctggacacataaacttggattggtccctggcttcactgcttccaaactcattaaaaaaacaataccaaccaccaagtcatgggtgaatgagggcaagatgtagtaacacagggaaatgaacagcccaattctatggcttaaacctttttggtctcaagatcttttttacactcttaaaaattgaggaccccaaagagctttacttatgtatgtcacacacacacacgccatattagaaattaaaactaagagattcctaaaacacaagaatacacaaggacacattttgctagcttcaaagagatgaaatcattacatgtcatgtagtctctggccaatctatatacacatgagagaatgagaatgaaaaagacaaataatgtcttagtttataatacaaacagttttgacttcagaccaaactcctcatgagacccactgggttaacacaatgcctggcagatagtaagtaatcaatatttgatagcataaaaaataacagtatacgtaattgataatacgtgtaaatctaggtgaaaaacaatagagaaaattaaataaataacacaatttatctttttttttcttttaattatgctcagaaagactagaaaacatccaaaatgataatggtacttacatataggtagtttgactaaagtgatttttccttcttactatctttctgtattttgaaaatttgctataataaacagatagtattttcaaaagga

SEQ ID NO: 105718 - DNA, 571 bp, Homo sapiens
  Payload ID: 724
  Gene Symbol: ARFGEF1
  Gene Name: ADP-ribosylation factor guanine nucleotide-exchange factor 1 (brefeldin A-inhibited)
  ENST ID: ENST00000519436
  CDS Start-End: 218-571
gcggtgcctctgagagccgccgccacctcgtccctcagttcccggcagacagccgcccgggccgggctccctcaccgccaccagggccggagggacgagtgagaggggcggccgggacgcgacccccgggccgggagaagcggaggcccgacgggcgcggccctcgagccgctgggagccgcgggtcggacgagccgccgcctccttctctgcgtccatgtatgaggggaagaagacgaagaacatgttcctgacccgggctctggagaagatattggccgacaaggaagtgaagaaggcgcatcactcccagctgcgcaaagcttgcgaggtggcgttagaggaaataaaagcggaaactgaaaaacagagtcctcctcatggagaagcaaaagctggatcaagcacccttccaccagtgaaatcaaagacaaattttattgaagcagacaagtacttcttgccttttgagttggcatgccagtccaaatgtcctcgcatagttagtacatctctagattgcttacagaaacttattgcttatgggcacttgactggcaatgctccagat

SEQ ID NO: 105719 - DNA, 646 bp, Homo sapiens
  Payload ID: 724
  Gene Symbol: ARFGEF1
  Gene Name: ADP-ribosylation factor guanine nucleotide-exchange factor 1 (brefeldin A-inhibited)
  ENST ID: ENST00000518789
  CDS Start-End: 1-578
tgcgtctgctgttaatgaagaagtcagcaaaattaaatctacagcaactggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataataggaccaaacggaccctgtgagcatggggctgccagtgaaaggaggatgcctgggaatgaaatcaatagaagagatgcagaaagcctac

SEQ ID NO: 105720 - DNA, 2734 bp, Homo sapiens
  Payload ID: 724
  Gene Symbol: ARFGEF1
  Gene Name: ADP-ribosylation factor guanine nucleotide-exchange factor 1 (brefeldin A-inhibited)
  ENST ID: ENST00000518230
  CDS Start-End: 1-2477
taggaaattcatggcatgagattctgaagtgcatcagtcagttggagctggcacagcttataggaactggagtgaaacctcgatacatttctggaacagtgcgaggcagagaaggatctcttactggaacaaaagatcaggctcctgatgaatttgtgggtttagggctagttggaggaaatgtggactggaaacagatagcaagtattcaggaatccattggagaaaccagttctcagagtgttgttgttgctgtagatagaatattcacaggatctacaaggctagatggaaatgccattgtggattttgtccgttggctctgtgctgtgtctatggatgaattactttccacgacacacccaagaatgtttagtctacaaaaaatagtagaaatatcatattacaacatgggaagaataagattacagtggtctcgaatttgggaagttattggagatcattttaataaggttgggtgtaatcctaatgaagatgtagctatttttgcagtagactccttgaggcagttgtcaatgaagttcttagagaaaggggagcttgctaacttcagattccagaaggatttcttaagaccttttgaacatataatgaaacggaacaggtctccaacaattcgagatatggttgtacggtgtatagcacagatggttaattctcaagctgctaacattcgatctggatggaagaacattttctctgtatttcatctagctgcatctgatcaagatgaaagcatagtggaacttgcattccaaacaaccgggcacattgtcacccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggctttcaaggaatacacaagcgatgatatgaacgtagcacctgaagacagggtgtgggtgagaggatggttcccaattctctttgagttatcctgtatcatcaatagatgcaaattagatgtaagaaccaggggtttaacagtaatgtttgaaataatgaaaacatatggccacacttatgagaaacactggtggcaggatttatttagaattgttttcagaatctttgacaatatgaaattgccagaacaacagacagagaaagctgaatggatgacaacaacttgcaatcatgcactttatgcaatctgtgatgtattcactcagtatttagaagtactcagtgatgtacttttggatgacatttttgctcagctctactggtgtgtgcagcaagacaatgagcagttagcgcgatctggtacaaactgtttagagaatgttgttattctgaatggtgaaaaatttaccctagaaatctgggataaaacttgcaactgcacactggatatcttcaaaaccacaatcccacatgcgctgttgacctggcgacccaattctggagaaactgcccccccacctccatctcctgtaagtgaaaagccattggatacaatatcacagaagtctgtagatattcatgattctattcaaccaaggtctgtggataacagaccacaagcaccactggtttctgcgtctgctgttaatgaagaagtcagcaaaattaaatctacagcaaaatttccagaacaaaaattgtttgctgccctgttgattaaatgtgttgtgcagctggaactcatccagactatcgacaacattgtcttcttcccagccacaagtaagaaagaagatgcagaaaacttagctgcagcacagagagatgcggtggactttgatgttcgcgttgatactcaagaccaaggaatgtaccgctttttaacatcacaacaactttttaagctactggactgcttattagagtcacatagatttgcaaaagcgtttaattccaacaacgaacagaggactgccctgtggaaagcaggattcaaaggcaaatccaagcccaaccttctgaagcaggagaccagcagcctggcctgtgggctgcgcattctcttccggatgtacatggatgagagccgcgttagtgcctgggaggaggtccagcagaggcttttgaatgtctgcagtgaagcactaagttacttcctcactctaacatcagaaagtcatcgagaagcctggactaacttactgcttttgtttctaactaaagttctaaagataagtgataatagggtaagtatgaggcttcgaatccagccccacatttctagcccaattcgcattgggatgcggggtcccagagccgccgtgcaagagctctcagagatgaatcaagcagtgcccaggctgcactgctgcttgtgcaaagccaccagtggccttgctgtatcttcctcagtccttgcttttctccccccttacccagctttgttcactaattagcagttctctaggggattcagtaggcgagggatcagaatcccttgggataccttgacaagttcccattatgaccccaggaatctccccctttgccccattttgaaaactgctgtccaaccacctcatggccttgtactctgcctactactcaagactacatctggttcctgggcctgtgctctgggctgcagctgttcctttggcatatttagtggttccaggtaacccagagtccctagtgaatgggcctcatctaa

SEQ ID NO: 105721 - DNA, 8852 bp, Homo sapiens
  Payload ID: 725
  Gene Symbol: ARFGEF2
  Gene Name: ADP-ribosylation factor guanine nucleotide-exchange factor 2 (brefeldin A-inhibited)
  Uniprot ID: Q9Y6D5
  ENST ID: ENST00000371917
  CDS Start-End: 1-5358
atgcaggagagccagaccaagagcatgttcgtgtcccgggccctggagaagatcctagccgacaaggaggtgaagcggccccagcactcccagctgcgcagggcctgccaggtggcgctcgatgaaattaaagcagaaatagaaaagcagaggcttggcactgctgcaccaccaaaggcaaacttcattgaagctgacaagtattttcttccattcgagctagcttgccagtccaagtccccaagggtagtcagcacatcccttgactgcttgcagaaactcatcgcatacgggcacatcactggcaacgcccctgacagtggagcccctgggaagcggctgatcgacagaattgttgaaaccatttgcagttgttttcagggccctcagactgatgaaggggttcagttacaaataattaaggctcttctgactgcagtgacttccccacacattgaaattcatgagggtactatcctgcagacagtgagaacatgttacaatatctatttggccagcaaaaatctcatcaatcaaaccactgccaaggctacccttactcagatgctgaacgtcattttcacccgcatggaaaaccaagtgttgcaggaggccagagaactggaaaaaccaatccagtcaaaaccccagtcccctgtgatccaagctgcagcagtatccccaaagttcgttcgtttgaagcacagtcaggcacaaagcaaaccaacaactcccgaaaaaacagatttaaccaacggtgaacatgccaggagtgattctggaaaagtaagcacagaaaatggagacgcacccagagaaagaggctcatcactgtcagggactgatgacggagcccaggaggtggtgaaggacatcttggaagatgtagtcacatctgccattaaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggaatcggatgcacaaggacatcaagtggctgccaggttctcccacgttctgcagaaggatgccttccttgtgttccgctccctgtgcaagctgtccatgaaaccccttggtgaaggccctccagacccaaaatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtctttttcaaagagattttcctgaacattttagaaacatcaacaagttcttttgagcacaggtggatggtcattcagactctgacgaggatctgtgcagatgcccagtgtgttgtggatatttatgtcaactacgactgtgatttaaatgctgctaacatttttgagcgccttgtaaatgatttatccaaaattgctcagggaagaagtggacatgagctgggaatgacacctctgcaggagctcagcctgaggaagaaaggcctggagtgcctcgtgtccattctcaagtgcatggtggagtggagcaaagacctgtatgtgaatcccaaccaccagaccagcctcggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgttcaacaagaaacccaagagggggatccagtttctccaggagcagggcatgctgggaacgtcagttgaagacatagcccaattcctgcaccaggaggagcgcctggattccacccaagtaggcgattttctgggagatagcgcaaggttcaacaaggaggtgatgtatgcctacgtggaccaacttgacttctgtgaaaaagaatttgtctcagccctgcggacattcctagaaggtttccgcctacctggagaagcccaaaagattgaccgattaatggagaagtttgccgcaagatacatagaatgcaaccaagggcaaactctgtttgctagtgctgacactgcttatgtcctagcgtattcaattattatgctgactacagacttgcacagtcctcaggtaaaaaataaaatgacgaaagagcagtatattaaaatgaatcggggtatcaatgatagtaaagatctgccagaagagtatctctcaagcatctatgaagagatagaaggcaagaaaattgcaatgaaagaaacaaaagagctaacgattgcaaccaaatctactaagcagaatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaactggtgtggacgccactattggcagcctacagcatcggactccagaactgtgatgacactgaagtggcctccttgtgtttggaaggcatccgatgtgcaatccgaatcgcctgcatctttggaatgcagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaatttggtgagtggcggagtggataaaagacagatggccagcttccaagaatcggttggtgagaccagctcgcagagtgtggttgtagctgtggacaggatttttactgggtctaccagactggatggaaatgcaatagttgactttgtccgctggctgtgtgctgtgtccatggatgaactggcttccccccaccatcctcgcatgttcagcttgcagaagattgtggagatatcatactacaacatgaatcggatccgactacagtggtctcgaatatggcatgtgattggagatcacttcaataaggttggctgcaaccctaatgaagatgtggctatctttgctgttgactcattaaggcaactctccatgaagtttcttgagaagggtgaattagccaacttccgtttccagaaagattttctgaggccctttgagcatattatgaagaaaaacaggtctcccaccatccgggacatggcgatccgctgcattgcccagatggtgaactcccaggcggccaacatccgctcaggttggaagaacatctttgccgtgttccaccaggcagcctctgatcatgatgggaacattgtggagctggccttccagaccacttgccacattgtcacaactattttccagcaccattttcctgcagccatcgattcctttcaggatgctgtgaagtgcttatcagagttcgcctgcaacgccgctttccctgacacgagcatggaagcgattcggctcatccgcttctgtggcaaatacgtctctgagaggcctcgggtgctacaagaatacacaagtgatgacatgaatgtagctcctggtgacagagtctgggtccgaggctggttccccatcttattcgaactctcctgcatcattaatagatgcaagttagatgtacgaacaaggggactcacagtcatgtttgagatcatgaagagctatggccacacctttgaaaagcactggtggcaggacctgttcagaatcgtgtttcggatttttgacaatatgaaactccctgagcaactgtcagagaaatctgagtggatgacaacaacctgcaatcacgcactttatgctatttgtgatgtttttacccagttttatgaagctttgaatgaagttcttctttctgatgtatttgcacaattgcagtggtgtgtcaaacaagataatgaacagttggcgcgatcaggtacaaattgcttagaaaacttagtaatatccaatggagagaaattcagtcctgaagtctgggatgaaacctgcaactgtatgttggatattttcaaaacaaccatcccacatgttttgctgacatggagacctgtaggaatggaggaagattcatcagaaaagcatttggatgtggatctggaccgccagtctttaagcagcatagataaaaatccctctgagaggggacagagccagctctctaacccaacagatgacagctggaagggtagaccatacgcaaatcagaaactgtttgccagcctcctcatcaagtgtgtggtccagttggaattgatacagaccattgacaacattgtgttctaccctgcgacgagcaaaaaggaggatgcagagcacatggttgccgcccagcaagacacgctggatgcagatatccacatagagacggaggatcagggcatgtataagtacatgtcttcccagcacctcttcaagctgttggactgtttgcaggaatcccattcattctcaaaggccttcaactccaattacgagcagcggactgtcctgtggcgagcaggttttaagggcaagtctaaacccaatcttctaaaacaagaaaccagcagcctggcctgttgtttgaggatcctgtttcgaatgtatgttgatgagaaccgcagggattcctgggaagaaatacagcagagacttttaactgtttgcagtgaagctcttgcctatttcatcactgtgaattctgagagccatcgggaggcctggacaagtctcttgttgttacttctaactaaaaccctcaaaataaatgatgaaaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaactgagttctgctgcagcttgtgtaaaagtgggcagtacacaagtacgtcccaaagcctgtgagcagtatacgtggatgctcacccatgagaaggagcacacacgcctcattctctgccctcacccactgctcacctagagcatcgctgagcgttagacaaagtgttacacagaatgattaaaactttcagacttctacctatgctctttagtcctgtaaattgggttgtattgatgtcaactctggtgccttagaagttagtagtttgggaacctatctgtaaaatcagatgttttttctttgtagagaaggatttctggtgcttttgcttactaagagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttctgatacgcatctttagagtcaaatatatcttttccctgtactcctcatgtacaaccaaagaacatacattatgaaaattgtattataatatctggaaacacaacattttcctctggcaggtgacttttgtacgaaatgaaaaaaaaaaaacctgtattttttttgttgttcttttgtgattaaggatatacatttagtagtctttgttattaaaggaacctgctgataagtacaagtgtgaccatctcattcaaatgtttgttgttatgatgcaaatggatattggtttcaatagaagctggatccttaatactgcattttctgaattctgttttaatatttgtgttaaagtagacatagctgaactcacatggaatcctggagttttgttatcagcagctttgcagtttgggaaacaaagaaaccaaagctgagtgttttaaagaatgaacatatctggaaatccttgctctcaaaacaaaacaatataatctatcaaaggtgttttactcagtgttctaatttttaaaaaattttatctgcatatttgcatcaaatatttatgtgtaaaatgtatgttttacctccttaaaatgcctaaaagttagttaatagttactttggtttaacctatacacaatgattaagtgcatttaatattggtaatttaatgaaaaccattccttgcccaatggatgtataaatttttgaaagaataagcagaattatataatatgaaatgctatgtaaagttttctatgtaaaaatattatgtataatactattaaaatatcccatgctttgatcaggtggtacatcaataaaattttaaaaagta

SEQ ID NO: 105722 - DNA, 3111 bp, Homo sapiens
  Payload ID: 726
  Gene Symbol: ARFIP1
  Gene Name: ADP-ribosylation factor interacting protein 1
  Uniprot ID: P53367
  ENST ID: ENST00000353617
  CDS Start-End: 300-1421
acaacgctacttccggtctcctcacttccggcttcgctgctcttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagt

SEQ ID NO: 105723 - DNA, 1302 bp, Homo sapiens
  Payload ID: 726
  Gene Symbol: ARFIP1
  Gene Name: ADP-ribosylation factor interacting protein 1
  Uniprot ID: P53367
  ENST ID: ENST00000356064
  CDS Start-End: 252-1277
ctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaa

SEQ ID NO: 105724 - DNA, 1601 bp, Homo sapiens
  Payload ID: 726
  Gene Symbol: ARFIP1
  Gene Name: ADP-ribosylation factor interacting protein 1
  Uniprot ID: P53367
  ENST ID: ENST00000405727
  CDS Start-End: 131-1156
cgctgctcttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtatt

SEQ ID NO: 105725 - DNA, 3424 bp, Homo sapiens
  Payload ID: 726
  Gene Symbol: ARFIP1
  Gene Name: ADP-ribosylation factor interacting protein 1
  Uniprot ID: P53367
  ENST ID: ENST00000451320
  CDS Start-End: 165-1286
acaacgctacttccggtctcctcacttccggcttcgctgctcttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaatcgtttctctggaccttcatagtttaagaagtaactatttggaaattctgaagacacataatttgcgttttctgaaccttaaaaaaaaaggtacttctgtcacttataattgttttagctcagtaagctattttttttcaatgtgaatctcttttgagagctgaacatgtccattcttaaccacatttcaataacagttactgtagctaaggagctaaatagtttcatggattaatttttttcagaataaatttaaaatatccatgattctgatagtgggcacatgaccaaaagaaaaaagtaaatcaatatatttagccaatggtacatttactttgttaggaatgtaatttatgttcattatagaaaagaattagaagaaaatttcaagtaatagaagataagtaccttcccaagtgaataaatactgcatggaaccactcaa

SEQ ID NO: 105726 - DNA, 1599 bp, Homo sapiens
  Payload ID: 726
  Gene Symbol: ARFIP1
  Gene Name: ADP-ribosylation factor interacting protein 1
  Uniprot ID: P53367
  ENST ID: ENST00000429148
  CDS Start-End: 163-744
aacgctacttccggtctcctcacttccggcttcgctgctcttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagc

SEQ ID NO: 105727 - DNA, 2746 bp, Homo sapiens
  Payload ID: 726
  Gene Symbol: ARFIP1
  Gene Name: ADP-ribosylation factor interacting protein 1
  Uniprot ID: P53367
  ENST ID: ENST00000618090
  CDS Start-End: 31-1056
gattcctgagtcactggacaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagt

SEQ ID NO: 105728 - DNA, 2543 bp, Homo sapiens
  Payload ID: 727
  Gene Symbol: ARFIP2
  Gene Name: ADP-ribosylation factor interacting protein 2
  Uniprot ID: P53365
  ENST ID: ENST00000254584
  CDS Start-End: 85-1110
aggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctcaaaaaaaaaaaaaaaaaa

SEQ ID NO: 105729 - DNA, 1868 bp, Homo sapiens
  Payload ID: 727
  Gene Symbol: ARFIP2
  Gene Name: ADP-ribosylation factor interacting protein 2
  Uniprot ID: P53365
  ENST ID: ENST00000396777
  CDS Start-End: 249-1274
agagctagctcgagtatcgccctgccctggctgcgacgtcagctccgcccttataatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagca

SEQ ID NO: 105730 - DNA, 1300 bp, Homo sapiens
  Payload ID: 727
  Gene Symbol: ARFIP2
  Gene Name: ADP-ribosylation factor interacting protein 2
  Uniprot ID: P53365
  ENST ID: ENST00000445086
  CDS Start-End: 151-921
gtcatttccgccgagtccctgacctgctgctaggatcgcgacgggaactggagcccgaggtccccgcgcggcccgggcctggcgccctgaggggaagagcggcccggcccgaggacctccagcaggtgatggtgtcaggacccaacctcaatgaaaccagcattgtgtctggtggctatgggggctctggtgatggactcatccccacagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctg

SEQ ID NO: 105731 - DNA, 1430 bp, Homo sapiens
  Payload ID: 727
  Gene Symbol: ARFIP2
  Gene Name: ADP-ribosylation factor interacting protein 2
  Uniprot ID: P53365
  ENST ID: ENST00000423813
  CDS Start-End: 220-1131
agctagctcgagtatcgccctgccctggctgcgacgtcagctccgcccttataatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttca

SEQ ID NO: 105732 - DNA, 852 bp, Homo sapiens
  Payload ID: 727
  Gene Symbol: ARFIP2
  Gene Name: ADP-ribosylation factor interacting protein 2
  ENST ID: ENST00000525235
  CDS Start-End: 127-735
ctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcagcccacagggagaaccccttcagggtgggcccagccctacccccagcagcactcacctgtggaggcagcctaagggaggaatttggctacaatgcagagacacagaaactactatgcaagaatggggaaacgctgctaggagccgtgaacttctttgtctctagcatcaacacattggtcaccaagacca

SEQ ID NO: 105733 - DNA, 1560 bp, Homo sapiens
  Payload ID: 727
  Gene Symbol: ARFIP2
  Gene Name: ADP-ribosylation factor interacting protein 2
  ENST ID: ENST00000531037
  CDS Start-End: 97-576
tgacctgctgctaggatcgcgacgggaactggagcccgaggtccccgcgcggcccgggcctggcgccctgaggggaagagcggcccggcccgagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgg

SEQ ID NO: 105734 - DNA, 3846 bp, Homo sapiens
  Payload ID: 727
  Gene Symbol: ARFIP2
  Gene Name: ADP-ribosylation factor interacting protein 2
  ENST ID: ENST00000614314
  CDS Start-End: 292-1416
agcttctcggtgccgccccggaagtaacctctcgctgatctcgagagctagctcgagtatcgccctgccctggctgcgacgtcagctccgcccttataatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgagggtgctggggtggagagttttactccaatacctttcctagccatgacggacgggatcctagggaaggcagccacaatggagatccctatccacgggaacggcgaagccaggcagcttcctgaagatgatgggctggagcaggacctccagcaggtgatggtgtcaggacccaacctcaatgaaaccagcattgtgtctggtggctatgggggctctggtgatggactcatccccacagggaagtcaatttcatgtgctcgaagagaagtatgggtggggccacagaggtgtctggtgtatctgagagaggctggtgtcagagaacttgatcctttagggtctggccgccatccatctcacagcaccactccttctggccctggagatgaggtggctcggggcattgctggagaaaagtttgacatcgtcaagaaatggggcatcaacacctataagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccctggccaatggcatcactcttcaggctggggtgtgctccctgaccaatgacagagcctgaaaatgccctgtcagccaatggcagctcttctcggactcccctgggccaatgatgttgcgtctaataccctttgtctctcctctatgcgtgcccattgcagagaaggggactgggaccaaaggggtggggataatggggagccccattgctggccttgcatctgaataggcctaccctcacccacccacccagtttaattgtgcttagagcccaagaagattgggatctagcactaggaataaacctttcataaaagcaggcccagcgaggtcaatttgtcggggactctaggagggtggcctgggtggagacaagctcagtctaatcaaacaccagaaccctatcaagtcaaaagagctggggccaggcagctgaagtcacaggtttcagagatggtttgaaggcccagtcttctctcccagcctcagttggagccaaagctttgtcctttagccagcaccaagatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggcaactacaaaacagtgataagtattaggatacagaagtacagagggcgctgtgggagcacaaaggaggggcatctggcatggactggggtggaaatggggatgtcagtttgaaagctgagacctggccaggtgcggtggctcactcctgtaatcccagcactttgggaggccgaggcgggcggatcaccaggtcaggagatcaagaccatcctggctaacacggtgaaaacccatctctactaaaaatgcaagaaaattagcccggcacggtggctggcgcctgtagtcctgtagtcccagctactcgggaggctgaggcaggagaatggtgtgaacccgggaggcggagcttgcagtggagccaagattgcgccactgcactccagcctgggcaacagagcgggactccatctcaaaaaaaaaaaaaaaaaagctgagacctgaagggtgagtagatgacaaacaggcagggtaaagggaagagcatcccaggcagagaggctagcatataatgaaggctctgagtaggaactgggaggaattgcttggaatgaaaaatgaagagggagtggctagatgaagactgcaggctggttaaggacttttgccctctggagaaggagctgagaagtgttttaagcagaaatttgactgcatgggagaagtatagagttgagaaaagtagtcctctgaggcttaagatagtgtcatctagactccagttccctcatcttgggtagcatagtagccccagcccaaaactgcaagcatgatccccgtctgggtttccttcacaagcactggagcatcttgtgctatgtgctgaactcaggtggataagaggttgaggcggttcccaaagctcctgctgcacccaggtgttgagcctaaatctgaaccttgtggagaggtcacaagaaagatccctaacagcactttggtttagtcagggctaggtgtcatcacctgtatgccctttggccaaggaaaccagaatttttcaggattttccccacctctggaaggctggaggaaggggaagacccactcagcagattcccatagtgcagggatcctcacaggcatgactttgccctttgtcatggatactgcagctcccagacagtcttctgggctttgatcagcctgcaatcatctgactagagcttgatttttggggcagggaaggtggtccttatatgagctgccacttaatgggccactggggatttttcaacatgaaaggtaccgagtctccaaatgctggttgtagggcctaaaaacagggctcaactccaggttctgccactttctagctgagtgatgagggctaacgtctggggagcaagatccctattttttcccattgtaaaattgggctaataaaagatgctacctactgactattaaataatatatgtaaagtggc

SEQ ID NO: 105735 - DNA, 1061 bp, Homo sapiens
  Payload ID: 728
  Gene Symbol: ARFRP1
  Gene Name: ADP-ribosylation factor related protein 1
  Uniprot ID: Q13795
  ENST ID: ENST00000607873
  CDS Start-End: 208-672
gggcagccgggaagcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcagaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatc

SEQ ID NO: 105736 - DNA, 1698 bp, Homo sapiens
  Payload ID: 728
  Gene Symbol: ARFRP1
  Gene Name: ADP-ribosylation factor related protein 1
  Uniprot ID: Q13795
  ENST ID: ENST00000612157
  CDS Start-End: 57-578
gaggtcagcgggggtcagcagcagcggctccgagggcgcggcggacgcagggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtgga

SEQ ID NO: 105737 - DNA, 1623 bp, Homo sapiens
  Payload ID: 728
  Gene Symbol: ARFRP1
  Gene Name: ADP-ribosylation factor related protein 1
  Uniprot ID: Q13795
  ENST ID: ENST00000618838
  CDS Start-End: 31-636
gaggcccgaggggcggcccaggactcgaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacgg

SEQ ID NO: 105738 - DNA, 2456 bp, Homo sapiens
  Payload ID: 728
  Gene Symbol: ARFRP1
  Gene Name: ADP-ribosylation factor related protein 1
  Uniprot ID: Q13795
  ENST ID: ENST00000619493
  CDS Start-End: 51-656
tgtgcggtgaggcgcgaggcccgaggggcggcccaggactcgagggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaagaaacctc

SEQ ID NO: 105739 - DNA, 1612 bp, Homo sapiens
  Payload ID: 728
  Gene Symbol: ARFRP1
  Gene Name: ADP-ribosylation factor related protein 1
  Uniprot ID: Q13795
  ENST ID: ENST00000618568
  CDS Start-End: 132-497
gctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatccc

SEQ ID NO: 105740 - DNA, 2554 bp, Homo sapiens
  Payload ID: 728
  Gene Symbol: ARFRP1
  Gene Name: ADP-ribosylation factor related protein 1
  Uniprot ID: Q13795
  ENST ID: ENST00000614942
  CDS Start-End: 149-514
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaagaaacctc

SEQ ID NO: 105741 - DNA, 2559 bp, Homo sapiens
  Payload ID: 728
  Gene Symbol: ARFRP1
  Gene Name: ADP-ribosylation factor related protein 1
  Uniprot ID: Q13795
  ENST ID: ENST00000622789
  CDS Start-End: 154-759
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcagggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaagaaacctc

SEQ ID NO: 105742 - DNA, 2974 bp, Homo sapiens
  Payload ID: 728
  Gene Symbol: ARFRP1
  Gene Name: ADP-ribosylation factor related protein 1
  Uniprot ID: Q13795
  ENST ID: ENST00000612256
  CDS Start-End: 709-1173
gcactccaggagcagccgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccagggcaggatgtacacgctgctgtcgggcttgtacaagtacatgtttcagaaggacgagtactgcatcctgatcctgggcctggacaatgctgggaagacgaccttcctggagcagtcgaaaacccgatttaacaagaactacaaggggatgagtctatccaaaatcaccaccaccgtgggcctaaacatcggcactgtggatgtgggaaaggctcggctcatgttctgggacttaggagggcaggaagagctgcagtctttgtgggacaagtattatgcggagtgtcacggcgtcatctacgtcattgactccaccgacgaggagaggctggctgagtccaagcaggcgtttgagaaggtggtgaccagcgaggcgctgtgcggtgtccccgtcttggtgctggccaacaagcaggatgtggagacgtgcctctcaatccctgacatcaagacggccttcagcgactgcaccagcaagatcggcaggcgagattgcctgacccaggcctgctcggccctcacaggcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccggaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaagaaacctca

SEQ ID NO: 105743 - DNA, 3241 bp, Homo sapiens
  Payload ID: 729
  Gene Symbol: ARL1
  Gene Name: ADP-ribosylation factor-like 1
  Uniprot ID: P40616
  ENST ID: ENST00000261636
  CDS Start-End: 176-721
gatgctcaggccaccgttcccggcgcgcagtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaagacgtcttcaatatgc

SEQ ID NO: 105744 - DNA, 1231 bp, Homo sapiens
  Payload ID: 729
  Gene Symbol: ARL1
  Gene Name: ADP-ribosylation factor-like 1
  ENST ID: ENST00000539055
  CDS Start-End: 102-509
gaagttgctggctgactgggcttgcgaggaaaccgcctcggagctgcagccgaaggccaaggaatcactgaagatcggcgagggaggacagggggttcatcatggccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaa

SEQ ID NO: 105745 - DNA, 1322 bp, Homo sapiens
  Payload ID: 729
  Gene Symbol: ARL1
  Gene Name: ADP-ribosylation factor-like 1
  Uniprot ID: P40616
  ENST ID: ENST00000536227
  CDS Start-End: 132-626
gttctcctccgtcctctctcggttccccttgattcctgcggggtccagggacccggacagcttggggacgtccgcagagcctgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaaccca

SEQ ID NO: 105746 - DNA, 470 bp, Homo sapiens
  Payload ID: 729
  Gene Symbol: ARL1
  Gene Name: ADP-ribosylation factor-like 1
  ENST ID: ENST00000551688
  CDS Start-End: 160-318
gtggaagttgctggctgactgggcttgcgaggaaaccgcctcggagctgcagccgaaggccaaggaatcactgaagatcggcgagggaggacagggggttcatcatgggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataa

SEQ ID NO: 105747 - DNA, 776 bp, Homo sapiens
  Payload ID: 729
  Gene Symbol: ARL1
  Gene Name: ADP-ribosylation factor-like 1
  Uniprot ID: P40616
  ENST ID: ENST00000551828
  CDS Start-End: 234-728
gcgttctcctccgtcctctctcggttccccttgattcctgcggggtccagggacccggacagcttggggacgtccgcagagcctgggttcgagttctttacccttatcatgaagttttccctcatccccagctccacttgctgggcagagttgttcttgcggaggctggcaacgcgtcagtcgcaggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctcc

SEQ ID NO: 105748 - DNA, 879 bp, Homo sapiens
  Payload ID: 729
  Gene Symbol: ARL1
  Gene Name: ADP-ribosylation factor-like 1
  ENST ID: ENST00000551671
  CDS Start-End: 109-693
cgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggcaagtatcatgcttccagaagccatctgtgcatttgtgtgtgcttgcagctatgcacgtccacgtgtaatttttctcccgtgttgaggatgaaactttgatttacttagcagcttatttcataagttcctcaagcgttttctctcactggtcttcaggtgcatctgtcttctcaaccacacctacctgattacagttacttagataagcaaattctttgccaatttttagccttttccctgcctcacctcaccct

SEQ ID NO: 105749 - DNA, 731 bp, Homo sapiens
  Payload ID: 729
  Gene Symbol: ARL1
  Gene Name: ADP-ribosylation factor-like 1
  ENST ID: ENST00000551092
  CDS Start-End: 118-312
cctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaaactgctggcttttaaaaaatatcctgaagatggtattgatcttgctaattgatgttttgtgcacacacctgcacatgtgtgggggagcagagcatactatttcgtcttaaatgccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttga

SEQ ID NO: 105750 - DNA, 590 bp, Homo sapiens
  Payload ID: 729
  Gene Symbol: ARL1
  Gene Name: ADP-ribosylation factor-like 1
  ENST ID: ENST00000548070
  CDS Start-End: 540-590
actttggatcttcatctgtaggggtggatccggcctctcgcgttctcctccgtcctctctcggttccccttgattcctgcggggtccagggacccggacagcttggggacgtccgcagagcctgggttcgagttctttacccttatcatgaagttttccctcatccccagctccacttgctgggcagagttgttcttgcggaggctggcaacgcgtcagtcgcaggttcgccgaggtttcttggtgaaagatgagctgcggccccagagtggaagcttaatcattctctttaccaggggcgctgggacggcgtcagtttgaaaaacctgagagcaggtgttgcttatgttgttttatggccagtttggcatttgtctgctaatctgctgtagcgtttcatgtaataatacgggtatttctagtcggcaaatgaaactttattcttggttcttggcccgctgattgagggaactgcattctcacaagcatcaggtggctttttctcaagtatattttccagtctgtttggaactcgggaaatgagaattttaattttgggattagatggagcaggaaaaaccacaattttg

SEQ ID NO: 105751 - DNA, 10845 bp, Homo sapiens
  Payload ID: 730
  Gene Symbol: ARL10
  Gene Name: ADP-ribosylation factor-like 10
  Uniprot ID: Q8N8L6
  ENST ID: ENST00000310389
  CDS Start-End: 97-831
gggtgggcgcggccgcagcagtcgcagcggggccatcttcggcgggcgagtgggctcggcctgtgcaacccgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggaccccgaggacgaggaggacgaggagccggcgctggaggagctggaacagcgcgaggtgctggtgctggggctggatggcgcaggcaagagcacgttcctgcgcgtgttgtcggggaagccaccgctggaaggccacatccccacctggggcttcaactccgtgcgtctgcccaccaaggactttgaggtggacctgctagaaattgggggcagccagaacctgcgcttctactggaaggagtttgtgagcgaggtggatgtgctggtgtttgtggtggactcggctgaccgactgcggctgccctgggcccgacaggagctgcacaagctgctggacaaggaccctgacctgcctgtcgtcgtggtggccaacaagcaggacctgagcgaggccatgagtatgggggagctgcagcgggagctgggtctacaggctatcgataaccagcgggaggttttcctcttggcagccagcattgcccctgcaggacccacctttgaagagcctggcaccgtgcacatctggaaactgctcttggagctcctctcctaggctggagctctcctgcttgccacctgcctgtcaagaccatagttgtactgctgctgcttcattgccagactgggcctggggcaagagccacatggcagcatttcccttttcccctcctttgcctttcaagagcagggcctgggcaaggccaagaaccatgcagaagccttcctggtgaggtggccgtgaagccgaagcagggaggtgggtgagacagagggtggggaggatagtgtctggctcattccaggctggaatgtggatccagctttcccttctcttacctgtacagtgagatgctcagtgggctcaatcctccactacaggtcccggtacctgaggaaccagtgtaggtgtcagaaatactcctagagcctcaaggtctcccagtccagaaacagtctggtgacgtcatgcccttctcatgtgggcagcttctgagtggtgacacagcaagcctttgttcctgtcctgcattgtccagccccagctccacctaagtgacttgtggccttgtgcaatctctgcctctctgaccccagggccattatttttaaagggaggtggtttcctaattcggagatgcctttcccagccatgggagtgtgaagtgctaggatgaacctggccatcctagcaaggagctttctgaagacctccctgcctttccctgagcccaggcctggcctgccagcctctcttgactacagaataactgatattcacccaccaaacagaaaaagtgaaggctgggtttttcccctctaatctggagacaagctgctgctctcgtactaactgtgccagtgcccatgtttacagaagtcaggggaaggaaggagcctgtgtccctgggacgacagtcaactggagctaggtgttgacctcagaactgcattttatttattaatttataagcagaacaggccagagttctaggctctgtttctaggtgctgttttcaaaaccccagatgacagtcatagaaaatttggaacttaggaaaatagctggaatcatgaatgacaatgagataacatacagatgtcagtggagacaaagttgtgggttcctcctcccacctggctttgaggctgtcgtcgatatcatagtactttacatggattcacatgaactgaaacgccaccacttggcccaggatgttgaaagggtgcaaattccttctgggtagataagaaatgactctgggagaggatttcccttatgtgaatctaggtaaaaagatggaaaaaaattgtattatgtgatcctaaggacaggaatagcagaccagccaacgggatggccttgggtacatcactcagcctttctggacccaatttttccccagtgaaagccaagttggactgaatttctggagttctcatcagtgcacattccatagttctccagtgcttggcgatcagcccaattgaaggactggctctgtactgacacttattatcggtacaggcaaagaggagcctgttgtctgttagggaccactaaatcaacaaccacaaatggattttttttttaagaggagctgtgcacctcaatttgctgtctagttgagaatagagattgtgtgccttcatttcatttgacatttacccagcatgcctcagttccacaccgtgaccagtgtaagaagaggaactatgataaaaacagttcaacaagccgcaaggagggtgggaaattctgaagtccagaagcgagtgtgatctttggaatagtggctgctgtgcccttgggcgccatttgaagaatcactgttcttgaaagtgctggttcactttctgcagtaagaagtgatttatgggcttttatgtaaaattttaagaatgacttgggtttcagagtagcctttgaaactttgctggcagcttttcattttgtcattggaaggctaagagacttttctcctttgttctatgaactccttgttcttcagggcttgaaggcaaaaaaaccttagacaactttaacgaagtttaaaaagtatgttctgtttttgagcagaaaaaagattcgtgaactggttagtacttagcaccaaaagcagttcagaatgctcagccccacaatgtgtgtaggctacatttatagccagagaaacgaaaataacttaggttgcctgattggctgcagtctggcatttgccttacctgaacatgttttagcagccttcagccgacgattgactgaaggtttggctgctgtgattggctaaaattcggctacttgttagaagaacatacttttaggttaggttacgagttgtttacacgttaagttacaattcactgtgtacagaggcagctttaggccagacttaattcagcttcacagtgtccctcattttgctcagccccttaattttgagagattgaccaaaatcccacgcactgacactaccttctgtcactatttgacctcattatggaactcacagtttacaatgttaaatcagttagcggattctgtatgtcttcatgtttctgttactctaaccgtaatgagaccatttgaggtacaaaggatgactgcattggtgtacttaagactacaacacatcagtggggaccttaggatggctatcaggagtgtaataccaagaaactggaatgcatcccttaatatgagtctccacaaaccaaactgattggaatcaaacaactcaagttcagacgataaaaatagttcaacagcgtgcaagctctgctgctcatagcctgttcagggtataatggcaattaaggacatagttcactatgaagtaccttaattgtaaagtgtttgattttttagttagcttttggtaacacaagtcatggtgattgggatacccactaaaagaaacatgaagattagaaaaccttgaacagctaagcttgctgtctaccattcaggatgcctgcaaaccaaccactagctgctcctgcaaacacattatgtgttccttttccctgagaaatatccttgatgtgtttggtggcagtatctacagaagcggcagccaccaccgccttttgaagctctccatagtagtagaatcaggaaagataagcacagcgttcagttttgttcagcaccatacacaagctcctagctgggcaaaggaaatctaaagctgcatgaagttccattacgtgtttttgttgaacacaggtggcctcatccatccatccatccatccatccatccatccctccatccgtccacccgtccacccgtccacccatccacccacccacccatccatccacccacccacccacccatccacccatccatccatccatccactcatccacccatccacccatccatccatccatccatccatccttccatccatccacccatccacccatccatccatccacccatccatccatccatccatccatccatccatccatccatccatccatcatccacccatccatccatccatccatccatctgtggcttctacctgtgcgaatctctgtgctacaaaattcttttcaatttagcattaactttaatttccatacagttggcacctcactgccgccaaaagtgagtccgcaggaactccactggaatatttgctcaggggaaactaactaatcatctgtttcaaggttggtattcattttagtctttgacctctgattatggggactttcagggaaagctgtttgcaaggtgagcatgaatcaggtgaaacagcaagatctgaagtcaggacagagtaagcaaattatccacagacctaatatgtaccctctgaagctggaaagtgggggccacctggtagcatttgagcaggggtcacttatgttcccccataagtctgcacagctcctaaacaaggtccagtgggcaacttatttttatgtggtccctttatagcatgctgtaagggtgcataaccacagccagtgagaaggaaccctactggatttaacccagtgacattatataagcaatcgcttggagccacataggtagttcccaggtcctgaatatgtggtgcctgaaagcataggtgtaggcagtgttccttgcataggcattacctggacaggtttttttccatattggcacttattaattgaaaaggtcagggtaccacttccaatgagtgtagggaagcaagcagtagtggtgtttagaatatcaaggttagctgctggatgcggtggctcacgcctgtaatcccagcactctgggaggctgaggtggacggatcacgaggtcaggagatcgagacaatcctggctaacacagtgaaaccctgtctctactataaaatacaaaaaatcagctgggtgtgacggcatgcgcctgtagtcccacctactagggaggctgaggcatgagaatcacttaaacttgggaggcagaggttgcagtgagctgagatcacgtcactgcactctagcctgggagacagagcgagactccgtctcaaaaaaaaaaaaaaaaaaaggttagcattccactcttcctttggggtttcagggtgacttattgggaaaatggagagatactggcattaatggaatcgtttcctgatttgagcgttaagtcacaaacccaacaggaactccagtttcttgctagagcattagcctttgctaaagccggccccagattatggtcccacggattttcccataaagaaagggaaaggatttgcggacagaaaataggaaagagagggagaaagataagatttttgcgattgcagtgaagtcttcatccacatctagggaaagctgttcatgtctaggacgtgatctgcttctggggaaaaacttccctggttagctttaccttaaagtctccaacaggtgtgtagttccaggagtctggagaggtccttttgagttgtgagatgtggacccaaggttcgaagccctgaagttttaccacagtgtgggtaatagaagaacttggtattgtctctttctgtgaggtttaagggcactttttctctgataccatctccagaagacctagtctcaggttacagattgtgaaggctttgatggtcctctgtgggtcacagaaagtttattttattttgtcaaaatacagtgtgacataatgcattacagctttgtagtatttagtggcatcagcatttaggagagtaggaactacgtgaagttctgttaggagcacaggctttctagtaactatttcataggggtcaatctgtgtctgtcgtaggaatggatctgatctgctgaccaaaggcaatggttggctttcttcttcagagatcagaaaaaaatgaaattcaaagccaatggtggtatctttggccaagataatccaatcgattcagttaattttgccaattttagttttaaaatatttgtccttttgacctttccagaagactgagggtgaaagggacaatggtagtaccactgtgtttctaacactttatttagctgcttcatagtttgtccaataaaatgagttcctctgtcactggagatttttccagagatgccccataaaggaaacacatgttcttataactccttagctactgccatagcatcagctctcctacacaggaaagcttctatccaaccagaaaacatgccaactattacaagaacatactgatacttaattgagggtggcagttgaatgaagtccatctgtaagcgttcaaatggtccatcaggtgttggtggaaatacaccacttggagtttttattatcttccctggattatgggtttgacaaaccagatattggttataacccatttcagcattttacagtggtcacactatcagtattttttataatctggatcatcttgctcatttgtgaggtgcagaggttgttttttgtttttttgttttgagacaggatctcactctgtcacccaggctggaatgcagtggtgcaatcatggctcactacaacctccacctccagagatcaagcagtcctcccacctcagtctcctgagtagctgggactaccagtgtgcgccaccatccccagctaattttttgtaatttttatagagagggttttatcctcttgcccaggctggtcttgaactcctgggctcaagctgtcagtccagctcagcttcccaaagtgctggggttatagggaagagccaccgtgcctggccaagtgcaaagcttttaacaatagaagtttcaagggctcaggaaggaccagggggccatctaggctctccatgagttcacgcttaacattatgtttacgtctgtcagataacaattttggttttccacatcaggtgcattgcactgttagatgggtcatcataaaggtcatcaatctagtggcattcattcaatttgcacatcctaactgtttcagcactatctgatttagcatgaaaatctgccagggcagtcccttgatattcaggttcagctttccatgtatgggcttcaatcttataagaatttgttatttatttttcacctttactcaagatagcttggaacttataccaatttgtgatggcaacaggatagtagcaagttcatccacttgagtctgtttttaataggggctccactagaagtgagaaaccctctttgtttccataacatgccaaaattgtggactgcaaaggcatgtatatatacatagcatgtctgctatgtatatagcattttctgatttccctttagctatatgataagctcaagtgagagcaaaagttctgcagtttgagctgactgaaactgggaagagtccgctttttattaactcattttgggttttaatgacatattttgccaaagaataatttcaaatgggggccgggcgctgtggctcacgccgggcgtggtggcaggcacctgtagtcccagctacttgggaggctgaggcaggagaatggcgtgaacccaggaggcagagcttgcagtgagccgagatcgcgccactgcactccagcctgggcaacagagcgagactctgtctcaaaaaaaaaaaaaaaaaaaatttcaaatgatgttggtctacttgctgaaaaatgctgggtttgactggaatttaatagactttccacagcacgtggaacttgcaaaaaaaaaagttcactccctaaaaccagatcagatgaaccctttaccaatctgggggttgctgccactgcctttaaacaattgggatatgccttagctatggggtctaattgcaggccatgatatgtgatgggcctgtgctttcccaactatgttcttttttatgtatgtatgtatgtatttattttttgagatggagttttgctcttcttgcccaagctggagtgcagtggtgtaatctcagctcgctgcaatctccgcctcccaggttcaagtgattctcctgcataagcctcccgagtagctgggattacaggtgcccgccaccacgcccagcttattttttgtatttagtagagatggggtttcaccgtgttcgtcagggctggtctcgatctcctgacctcaggtgatccacccgcctcggcctcccaaagtgctgggtcaactatgttcttgagtaagaactcctgatgcctgattgttatgtttatgaacaaacaaggtgaagggttcagtataagttggaaatcctagagcaaccatatctgttactttccatcctggttatatttcttaattagactgcgaagttctgaatgaagtcctttttaaatagagcagttaatgccatttctgtctctgcaggtttcacaagtagtgtttctaaatgagctctataatctgaaaccggttcatctttcttttgcccacaagattatgtgattgaccaatcaattttttgtggaaaagccctagggattgaatttaaaagatcttcagcaattcttccagttcctttttgcctcctcttggggttttggagtggtctttagtatcctcaggctgttgccattctgctcctgctgtcaattttcaagcttcaccagtatcatgtgaataaattggtaaagattagagagtcctgaatcataagctcttatgaggattctcaattttccagtacgtttttgagtattttctcttggattagttaagtctttatgatggctctaagctcagctttagaccatggagtaaaagtggttacagcaggcaggctggttgactagagagtctcactttgtaaggcatttgtccaacttcccctttttcattagcctcaaggagaaaaggtaactgagcaaaagggttactgtactcaaagcatcgaggcaaagaagagacagagaaggagcaatccaggttcatgtgctgcatgagcctttcatttgcgttttgtaaagaatcttttaggcaattttagatttgtataatcctttagatgcctctgcataccgatttaaaatgcatcccgttgtttttgtggcgttttcgatcctttcttttctaatgtgtcccataaataaacagttttatttaaagtttcctcatcgtggccattttaattctaagttgttcctagtaaggttaacctgtttttctaaaaacaagttctgggtccataattttggtttttttttttttttttttttgagacagagtcttactctgtcaccacccaggctgtagcgcaatggcacgatctcagctcactgcaacctccgcctcccaggttcaagcaattctcctgcctcagcctctcagcctcccgagtagctgcgatcgatcacaggtgtgcaccaccgcccagctaatttttgtatttttagtagggaggggtttcgccacattggccaggcaggtgaggtgatttgcccgcctcggcctcccaaagtgttgggattacaggtgtgagccatcacacccggacttgttttgttttttgagatagagtgttgttttgtcgcccaggctggagtgcagtggcgtgatctcggcttactgcaacctctgcctccagggcacaagagattttgccacctcagcctcctgagtagctgggactacaggcatacaccaccacacgcccaactaacttctgtattttttgtagagatggggttttgccatgttgcccaggctggtctcaaacttgtgagctcaagagatcttcctgcctcagcctcccaaagtgctgggattacaggcatcagccaccacacccagccccataattcttacatataaaattagatggagtcccagactccttggattgaaacaaacccgttatcaaaaggataacctacccaatgcctctaactggatccatccagtttattatgggatgcagtccaatccaggacccagtccagtaaaaattgctcagataaacttggagagctcaaaacacaaatttatggagctcagaatcctaggaagaactcactatgacctccagttgctgtgaggggtcagtgggcacaatgggccctggcagataccttttttgcatggtcactcagtgctcctggaggttgctgaagttatactttggatcctacttctgacaccagtttgttaaaagaaaaattttatagacaagttaactttaacagagcagaaaagggttcatgaaccaggtagtgctcaggaccaaaagcgatggttcagaatgtgtgcaggctatatttataagcaaagaaacggaattggcatacagagatagcctgactggctgcagtctggcgtctgccttctttggacatgttttggcagccttcagcctatggttggctgagatctgactacttgttacaagagtagactcttacatcaggttgcagggtgtttacacattaagttaggttataattcactatgtacagaggcagctttaggccaaacttaacaaaggtcacctttggaaccagcactaattgttgagggggtccctggggtccctttttacctaatgaagatctgtctgagtctaatgaatatattgtacaatttttaaagtccccagttgtgggaggtgaacttgaagaataaagtttcattatgttta

SEQ ID NO: 105752 - DNA, 258 bp, Homo sapiens
  Payload ID: 730
  Gene Symbol: ARL10
  Gene Name: ADP-ribosylation factor-like 10
  ENST ID: ENST00000514533
  CDS Start-End: 1-145
gagcgaggtggatgtgctggtgtttgtggtggactcggctgaccgactgcggctgccctgggcccgacaggagctgcacaagctgctggacaaggaccctgacctgcctgtcgtcgtggtggccaacaagcagatgttaaaatgaaaacagcgacactgaacaatttcccgagggtgctgaggccccagcctcctgttcgtccttgatttctccttccttcccatcccccgtgcaagtcatcagcagggcctgtcatc

SEQ ID NO: 105753 - DNA, 380 bp, Homo sapiens
  Payload ID: 730
  Gene Symbol: ARL10
  Gene Name: ADP-ribosylation factor-like 10
  ENST ID: ENST00000503175
  CDS Start-End: 1-240
cctgacctgcctgtcgtcgtggtggccaacaagcaggttctgccgtaccgatttagcgtggtcccaggcatgtcggatgtgggagctaccggcaaagagagacatcgcggatccgtcatctcgcggaccgtcccggccgaggcccacggccacccggaaccccagccccctcaccattcgatccgcggcgctgccttccgtcgagcattccggttcagacgctttcggttgacactgtaaccaaacttctgcctccgggttttgcccttggccttgggcatcgcgctgaccaccgcaccagcagctcaaacacgctgcctctgtctctcagacctcgtgtaacaaactccttccggaaggcgtgcacaaggctttgcggg

SEQ ID NO: 105754 - DNA, 3760 bp, Homo sapiens
  Payload ID: 731
  Gene Symbol: ARL11
  Gene Name: ADP-ribosylation factor-like 11
  Uniprot ID: Q969Q4
  ENST ID: ENST00000282026
  CDS Start-End: 336-926
cacccaagtctgagttgctaaaaaatggagctgtcactgggccttgctctgccaggacctgcagagccggggacctctctgtggcaagcccagcaagatgactgctctgaggcgccctagggctgagggaggggccgtgacaccagccccgccccccagccacctgggaaaaggaagcacaaaaaggagaagcagcaacggctgctctgcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcggcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataataataataatgatgatactctaagaaaaaaatctcaacatacttcatttaatagctcgttaccaagtgtgaatgaagcaatatgtcataatagagtagccactggttgcataataatagagacctaaattctcaaatagggaaagaggttttaaaatcaaatttgaggccaggtgcagtggctcatgggcggaggagggcagattacttgaggctaggagttcaagaccagcctggccaacatggtgaaaccccatctctactgaaaatacaaaaattaggcatagtggtgcacgcctgcagtcccagctactcaggaggttgaggcagaagaatcgcttgaacccaggaagtggaggttgcagtgagccgagattgtgctgctgcactccagcctgggtgaaaaagacaggctgtgtctccaaaaagaaaaaaaaaagtcaaattcaaatatcatctggacatgtcacaatggatcgcggatccttatgagtgattttccccagtggcccctggggatgtgccactgtcactcagaagggcaagctaggcagggcccatacaacagcaggggtctgcaggttagacgttccctgccctgggacgctcacccctgggcaagaggctggaagttcacaccatccaaaatttatccttgttttttttctgatgctaattagcctctcccgattttatgacatcttgtgttgatctttttcaaaaactcattttcttttttttccttctcttttctccttcttgtagcacatatctttcgttaaagatcagatcaataaaatattttatttattcattaatttaacaaaaaaaacagagcatttagtttgtggcaaaaacactgagctttcgaatatgaatcatgtgctttaggtgggaattgtgaattctgaagatacagatgacagtgacgaatgccttctgtctcatgattgacagggaaaaggaaggttgaccatagcatcctagaaggctcatcaggtgatcattacctagcatccatgaagcacctgaaattatttgcaaaatgttacgctttggaccatttttccggggaaggagatccagaactttttaccagattttcaaagacatctgtgactcccaaaagttaacaatcactgatgtggttgttgtatccctcatccaaccccagaacactttctgtaatctgagttttttaatggcaagtggcctatatttagcacctgttctcatgttaaacagctctgaatgttagatattctttcttatcctggactggttctctctatctctggagtaatgcagtataaattggccatcagtaccctcctaaaatctgagatctgccaggcccctcttctaacaccaggttaggcatgcttggttatttccagtacttgtcagtcaacatgtttcaagacgctgtgttagacactagggatgcaaagatgaatgagataaggcctcaggcctcatggaaggtgagacagtaaagacattactcccataaaaatgtgaggagagagactcagttcagcaactgtttattctgtttattgagcacttacttggaccaagcactgtggtcttggtgttttacatagactgtctctaattctcacaactctgcaaaatatatatattcccattttataaaactacaaactgaggctcagagaaggtgtgacctcttgttgcttgaggcacagagttataaagtaacatatctggaatttgaaatcagatctgtttagggctaatgctgcatttttctacaacatcatgcctctagaaggtttaagctaggtaggctttcagccagcagacatgatggggagagccttctaataagagggaagagactgcttggaagcatgaagggaggtgtaagaaagataagtaagtcagtgtacttgcaacagaggcttgggatgaagggtgggtgaagttgacatcacgatagaaaacaaaactggaatgggagtttaggtccaatttgggcaaggttgtttgaatttcaataatcaggggtttgggtcaaggaagaaaaatcatgggacttgccatttaggaggataattttgtggtagtgtggaggtgaaataaagagaaaagggaaccttggagctgggaaggcaggaaaccggctagatgaccatcacacagcaaaggagggagtggaagagagatgagaaaattgagagctattattaagaaaaacagttgagagaggaagaatttgaagagggctcaagattttgagtccacatgacagaaggactggaatgccatgaactggagaaggtgagcgctgaagaaccaggatgggacggggctggaacagctgggttcagcttttgcagggtgggtacgtgtttggttatagctgctttcagattgttccattatctgtactcccaacaaccctgccggatatatttgttggctttcactc

SEQ ID NO: 105755 - DNA, 489 bp, Homo sapiens
  Payload ID: 732
  Gene Symbol: ARL13A
  Gene Name: ADP-ribosylation factor-like 13A
  ENST ID: ENST00000372953
  CDS Start-End: 1-489
tttagcaaacaaacaagacaagaagaaagccctcatgccttgtgatattattgactatctacttctaaagaagctagtgaaagagaataagtgcccatgccgagtagagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagaaagaagccatcaaatcaatcctatactcactgagaggctcaagaagagtgagatggcatccattgagaatgaagaccaccttggtaaaaaagaacagagactttacatctttgtaccgagatgc

SEQ ID NO: 105756 - DNA, 1102 bp, Homo sapiens
  Payload ID: 732
  Gene Symbol: ARL13A
  Gene Name: ADP-ribosylation factor-like 13A
  Uniprot ID: Q5H913
  ENST ID: ENST00000450049
  CDS Start-End: 114-884
aagaaggctagaaagctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaattacttcccagtaagacagaccattgcatgaaatcggaactgactacacttttgttagatgagtatgaactttccatctatgacctgaatggagacctgaagggccgggaagcatggccaaactactatgcacaggcccatgggcttgttttcgtcctggattccagtgacataagacgcatgcaggaagtgaagatcatcttaacacatctgctgtccgataaaagagtggcagggaaacccatcttaattttagcaaacaaacaagacaagaagaaagccctcatgccttgtgatattattgactatctacttctaaagaagctagtgaaagagaataagtgcccatgccgagtagagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaa

SEQ ID NO: 105757 - DNA, 1535 bp, Homo sapiens
  Payload ID: 732
  Gene Symbol: ARL13A
  Gene Name: ADP-ribosylation factor-like 13A
  Uniprot ID: Q5H913
  ENST ID: ENST00000450457
  CDS Start-End: 117-989
gacaagaaggctagaaagctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaattacttcccagtaagacagaccattgcatgaaatcggaactgactacacttttgttagatgagtatgaactttccatctatgacctgaatggagacctgaagggccgggaagcatggccaaactactatgcacaggcccatgggcttgttttcgtcctggattccagtgacataagacgcatgcaggaagtgaagatcatcttaacacatctgctgtccgataaaagagtggcagggaaacccatcttaattttagcaaacaaacaagacaagaagaaagccctcatgccttgtgatattattgactatctacttctaaagaagctagtgaaagagaataagtgcccatgccgagtagagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagaaagaaggtacgagattatggtctaaaaagaatatgtcagtaacatttgctttagatgaacccatgaaagaaggtgaatgttctaggagaatgagagctcagaatactacgaagctttgctacaattgaaggagtggcttatagactccagctccatatgctgatgacaatatttttgaagagaaagtaaaagaaagtaacagagaaagtaaagagaaaaacagagggaaaccaaaagaaacagttgatatccctcccttagcaaacaggttcatctccagaactatcaggactacccggtttttaaatttccatttgataatatttctacactccccatacaactccacctactctaatatcacatccctgagaacccctgttgttcctgtatatctatattctagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaaataaatagaacttctttgctgag

SEQ ID NO: 105758 - DNA, 693 bp, Homo sapiens
  Payload ID: 732
  Gene Symbol: ARL13A
  Gene Name: ADP-ribosylation factor-like 13A
  ENST ID: ENST00000494863
  CDS Start-End: 1-373
catcagaaaccttgaaagaagaaaccatcagcccatagttgaaggactgcgctggctattagctgtcattgatacttgccaactaccacctacctcgagcatctcaatctccaagaataacacaggctctggagaaagatgctcatcacacagcttctccaccagaacaggaatgtcaaaggagaaaagacagcatctagaacaatgctcaatcgaagctaagcctctaaagtcaatcctacagaaagaaggtacgagattatggtctaaaaagaatatgtcagtaacatttgctttagatgaacccatgaaagaaggtgaatgttctaggagaatgagagctcagaatactacgaagctttgctacaattgaaggagtggcttatagactccagctccatatgctgatgacaatatttttgaagccatcaaatcaatcctatactcactgagaggctcaagaagagtgagatggcatccattgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaaataaatagaacttctttgctgag

SEQ ID NO: 105759 - DNA, 3264 bp, Homo sapiens
  Payload ID: 733
  Gene Symbol: ARL13B
  Gene Name: ADP-ribosylation factor-like 13B
  Uniprot ID: Q3SXY8
  ENST ID: ENST00000303097
  CDS Start-End: 283-1248
acgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcaggttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaa

SEQ ID NO: 105760 - DNA, 3659 bp, Homo sapiens
  Payload ID: 733
  Gene Symbol: ARL13B
  Gene Name: ADP-ribosylation factor-like 13B
  ENST ID: ENST00000335438
  CDS Start-End: 235-504
ggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagagatggggtctccctatgttgcccaagctggtctggaatgcctagcctcaagctattcttctgccttggcctccaagagtgctgggattacaggcatgagccaccacgcccagcccggccagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaa

SEQ ID NO: 105761 - DNA, 2453 bp, Homo sapiens
  Payload ID: 733
  Gene Symbol: ARL13B
  Gene Name: ADP-ribosylation factor-like 13B
  Uniprot ID: Q3SXY8
  ENST ID: ENST00000394222
  CDS Start-End: 276-1562
cgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgca

SEQ ID NO: 105762 - DNA, 3203 bp, Homo sapiens
  Payload ID: 733
  Gene Symbol: ARL13B
  Gene Name: ADP-ribosylation factor-like 13B
  ENST ID: ENST00000460371
  CDS Start-End: 255-425
ggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggaggaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaata

SEQ ID NO: 105763 - DNA, 2206 bp, Homo sapiens
  Payload ID: 733
  Gene Symbol: ARL13B
  Gene Name: ADP-ribosylation factor-like 13B
  Uniprot ID: Q3SXY8
  ENST ID: ENST00000471138
  CDS Start-End: 270-1556
gcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaaaggtgactcttttgatggtgggacttgataatgctggtaaaaccgcaacagcaaagggaatccaaggagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaa

SEQ ID NO: 105764 - DNA, 3906 bp, Homo sapiens
  Payload ID: 733
  Gene Symbol: ARL13B
  Gene Name: ADP-ribosylation factor-like 13B
  Uniprot ID: Q3SXY8
  ENST ID: ENST00000535334
  CDS Start-End: 524-1501
agcacgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgttggcaaataaacaagataaagaaggagctttaggagaagctgatgtcattgaatgtctatctctggaaaaattggtcaatgagcacaagtgcctgtgtcagatagaaccatgttcagcaatctcggggtatggaaagaaaattgacaagtccattaaaaaaggcctttattggctgctacatgttattgcaagagactttgatgccttaaatgaacgcatccaaaaagagacaacagagcagcgtgctcttgaggaacaagagaaacaagaaagagctgaacgagtgcgaaaattacgagaagaaagaaaacaaaatgaacaggagcaggctgaactcgatggaaccagtggtctggctgagttggacccagaaccaacgaatcctttccagccaatagcatctgtaatcattgagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcagctaatggtaaaaagaaaactaagaaactaagaatgaaaaggaaccaccgggtagaaccacttaatatagatgactgtgctcctgagagtccaacgccacccccaccccctcctcctgttggctggggaacccctaaagtcactagacttccaaaacttgagcctcttggtgaaacacatcataatgatttctataggaagccactgcctcccctggctgtgccacagcgacctaacagtgatgctcatgatgtgatctcataaacaagacgtatggaggagttctcttaatatcagcaaggtgaactgggacattcttctttctcagaagaagaaacatcttgtaaattgatgactggggcaagataaccataataattttagtgagaagattaatactcaaggacctgacttgataattacttatttgtgtttttcatggttaaaaaaataaaagaagcacaatgaccagtacatgaaatcagcatttggaccaaattagcaagatttactgttgactctggtttatacatccccactcatgagcatacttctgaaggaaaactttacaaaaagagccaatggactcagcactttctttactatttgttcaatagcctatatttctagatattaaatattttttgtaagatatatgcacatagaagggggacttctaggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatatttttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaatattctgtttctcttttcaattggtagatttaaatgatttcctttgggtaataaaataggtaaagattttaaaatatgattattgaaaaacagtttaaatcagtagattaaaataatgcatttttttgatactttacacacaaaacttttttctctctgcaagtttttatgtatgtgggaaagaatttgtgattttaaatgcagctacaaatagcatttcaccatatgatgttagaggatttgatgtctgtcttgcgttaaagctgttggtcaacagatatgtttttatgtatttaaaagaggctcttgtgtgcctttatgtgtaaaatgcatattacgtagtatacatgatattgtatgtaactgacttcaaatataaaactatgcat

SEQ ID NO: 105765 - DNA, 1294 bp, Homo sapiens
  Payload ID: 734
  Gene Symbol: ARL14
  Gene Name: ADP-ribosylation factor-like 14
  Uniprot ID: Q8N4G2
  ENST ID: ENST00000320767
  CDS Start-End: 189-767
tgataagctacaacataaacacatctaggttcttgttcttagaatacagcatgaagaatttgctttcttctttcttcctaacattttcatgtgagatccagaaaggacacattgtctctggccattcgaagaaagaaagaaagaaaaaaaaaaaaggtatttagagacagagagagaaaaaggctgaaatgggttcgctgggttctaaaaatccgcaaaccaaacaagcccaagttcttcttttgggacttgactcagctgggaagtctactctcctttataaattaaagcttgctaaggatattaccaccatccctacaataggtttcaatgtggaaatgatcgagttggaaaggaatctttcactcacagtctgggatgttggaggacaggaaaaaatgagaactgtttggggctgttactgtgagaacaccgatgggctggtgtatgttgtggacagtacagacaaacagcgactggaagagtctcagagacagtttgagcacattttgaagaatgaacacattaaaaatgtgcctgttgttctattagccaacaaacaagacatgcctggagctctgactgctgaggacatcaccagaatgttcaaagtgaagaagctttgcagtgaccggaactggtatgtgcaaccctgctgtgccctcacaggggaggggctggcccaggggttcaggaaattaactggatttgtgaagagccacatgaaatcaagaggagacactttggcgttcttcaagcagaactgaggctgcgaaaaatccaagtctctacagagacactgatgaagttgaaagggtaattgtttttccatgccaaatgaggaaatcaaattaatgagttgacaaacttttcctgagatgttatttcatctacatttagttaaacaacttagaatgatatctagaaaatatttattttcagccaggaactttagcaaactgtggcaatgatcactgggaatgaaaacgtataatgttctacaatttttgttatcacattggatgactttgaatatagtagtgacacttgggaccaaataaattattttatatgactactagaacaaagttttagtaagctgtctgctaatagagtcagaattcttccagattgtttccagctgtaacaggtattgaatttccaccgtgctcctatgtaacagctgggtggtgtaaaaaatgaacttcaaattatggagtggaaaaagcgtaatgttaatatcttgtaaattcgtattccctattaaataaagctttcttattccctaaataaa

SEQ ID NO: 105766 - DNA, 2430 bp, Homo sapiens
  Payload ID: 735
  Gene Symbol: ARL14EP
  Gene Name: ADP-ribosylation factor-like 14 effector protein
  Uniprot ID: Q8N8R7
  ENST ID: ENST00000282032
  CDS Start-End: 216-998
acgtctctttgtggtggcgttgagctcctctagcccgcgcttgccgtcctctcagtggtagcgcggggactggctgggaagcggtcggtcgagtgtggcctgtgtggactcgcatcttgcccgaagccgggcggaggagagctcaagctaagggtgatcagcccatgacctaaacctccagacaaaataaaacggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggtaaaagagaaaaaagaaggcttacaaaaaatgcaaccgctggttcagacagacaagtgataccagcaaagagtaaggtctatgatagccagggtctcctgatttttagtgggatggacctctgtgactgcctggatgaagactgcttaggatgtttctatgcttgtcctgcctgtggttctaccaagtgtggagctgaatgccgctgtgaccgcaagtggctgtatgagcaaattgaaattgaaggaggagaaataattcataataaacatgctggataatctgcggtaccaaactatggagcctttaaaggtctttatttctaaaaatctgttactctaagatacattttaagcttgattatcatatgacaaagattttaaaaccatctcagtgtgccctaatttttcatcttgggtgctttaagattcactatttgatataaattcagataggctatttttcagtagtcagcgttaagcctgtctggatcaatataaacaagtagggtgtaggcagtcctctatttgcatgtttcccatgggcacaaatttcagtgacctagatttagtttaaataccagtttccttaccaggaaggaaagaaaactggtaaggaaactgttgttgttaaaatctaggttaaaattttagttagcacattgtaactgagtaattacatgaagtacaaacctctctgctagctcttcagtctacaaatcgctatgtaaataacagatatgcttcatgattgtgaccagtcatgttatttctttcaaattcttccagtggtttgtccctgtgcatctgttaattcagttcacgtacagcagagcatgtagttatgctgtctctctgtcatctacttgacattctatagaagtgaacactcgaaagaactggtcaacaaagatgaaagtgcagcaaagcaatgaaaaatgataacactggaagtgaaattttaatcaaacataaatgaatttgtagaagaagtcactgaccatgggaatgttgttcttgctgctgtgtattcataggagcttagtgaaggcaaacttaccaacacaaataagcaaagtggttgcaataaagacagatacgtcccagaggaagtgatggttaaaaaaaaaaaactttacattaaaagatatttaatgtgaatatagaaatatttcacaacattgaaagcacaagcaataaaagggtggaagctgacccaaacttagaaggagtatggcagtttgccgtgaacataaaagatgcttactcagtatggtaagttacttgccagaaaaaaaggcaagccctattcaaactactttgtttttacaatgaaataaaacactttaattctatttctaatgttttaaattacagtgtactaaatatttttaaacatttttgcatttttttctacatttataactggtcttaagagtttttaatatttgagcagaaccttaaaggtcatggaacaatcatcattttccctattgattattaagattgcaggaccatttttatggtcccacagtaccatgtgaaatgaggatcgcttgtagctgggaacagtgcttacttcagggaaaactgattttgatagaaccgactagttgagtattaaactgttttggaaataatttatatatctaagtgctgaaatatatttctcttctccccacttattcaaataaaaaagttttaatactataaa

SEQ ID NO: 105767 - DNA, 3417 bp, Homo sapiens
  Payload ID: 735
  Gene Symbol: ARL14EP
  Gene Name: ADP-ribosylation factor-like 14 effector protein
  ENST ID: ENST00000530909
  CDS Start-End: 2914-3417
atacattgccacatagttcgttgccttgtaactttacctctgatttcctttttctcctccttaatttatcttaatccaattatctgtttgaagaaaaaaaaaattttttttatttttttattttttgagatgagagtctcgctttgtcgcccgggctggagtccagtgacacgatctcggctcaccgcaacttccgcctcctgggttcaagcgattctcatgcctcaacctcccatatagctgcactaccacacctgactaatatttttgtatttttagtagacacgagatttcactatgttagccagtctagtctagaactcctggcatcaagtgatcaacccacattggcctcccaaagtgctgggattacaggcaggagccacaatgcctggctagaagaaacttttctaattattactgtgatagaagccattttatctgatttgattgggacctgtattagttcattttaaaaactgactaaaacacagtaaatgaatataaatatactctgtttttaccagctttaaaacttttttcagttaaaatgttcagtaacatattttaacactttaaagtgtattttattttttaactttgtaaatacagtattttgacctaaaacacagacatttattcgccattttttgttacctgaggccagagtcttctttttatatgattttgctgattattgtttttctctgcagaaaccatatcaaaatgtgtttaagatttctctccagtttttgttttttttttaattttgcaaagcttaaaaacacttgtaaaattgctgaatcctagacttcacagtccctccctaccactcagatttcagtggttcacattttttctcaacagcagattttttcctaatgagttgcattggttgcatattttcttgagaatccaacttttttttttaatttgctttgaaaattatttatgaaaaatttcaaatagaaagtatggacagtagtgaagcacttatgtacatgtcaccaaaccttattttctgtaaatctttttggggaaaataatgttttttcccctcagaagtatccacaaatgtgatatatgttactcttatgtatattttagtatatattcatgtttcatctgtaaatcttatgtactatcttatctttttaaattttacctttaatgatgatactatataacctttacaacttttttcacttaagattgtctttgagatttattcatgttgattcacgtaattcatgtagtttattcattttaactgttatgtgggagtcccttgtatgagtaacgatttcacatcctttacaattaggttatttgtcatctttcactgccaaaggcagtgaatgctgaaagttttcgtatataacttgtgctcttattggagatatttttctccatctgacacccagaactgaaaagagctgagtcccaaggtgtatgcttcctcagttttacaagaaattgcagaaaatgttctaaagcagttgcagcaatttacattcctaccaaagttattataaggagcatgtgagagttggacacatcttaaccagatatcagatttttaaattgatttcaagcaaatgtttaataaatgatatttaatttgcattttcctaggaactatgggggaaacagtttgtatgcatgtattggcttttgttctctttctctgtgaattgcctgactatatttgtttagttttccagtggactctgtcattttctaattgatttttggaagtgaggagttactcgaatatttatgataataatcctaacacctttcaagtgtctttttttttctcctttagttatacagaaatgtgtaaattttacatataatcaaatatatccatctttttatttatttatttttttggtatctgcttgcttgtttgaaaaattcttccatacttccatgtcagaaaaccttctttattttctcataaacatgtttagtttttcttttcatgtttaaatctttaatccacttgttattgatttttgtttgtgcagaagagatctaattgtttttccatatggttaaagtcccttcttcattagtgtgtgatacccatcgattaatagtaccacatgtcatatactgagccctcatctactcatggatctgtttgtttatactataccaataccatagttttaattagaataggtttaaagtaaatcaatatgttactgtattttccttcaggattaccttggctttcttagacctttgctctttcatatagaccagcttgctaaattccaagggggtggcagtagaatatctgatggaactttgattgtaacagaactgaatttacagatgtattcccagataattgacatattttttataatgagccactccatgatatatagctgcatttatttagggtaccgtttttgtcttgcagtttgataattttctccatgaaggtcttgttgtatgtcttttgtaagagtcacatattttgtaagatacagtgttttttggtttctagcatccctggtgaattctcttattagttctaatagtttgttaaacctcttgtatttctcatgtatcttaggataatatttcttatttcctcctttttaattcttatgtggtcttaaatataatctgtaattgcagatgttttcgtgaagttctgactttacagggaacgcttctgtttgattattaaatgtctattataagacttcgataaataccttttttattccttattttcttttagataggtgttgaattttatcaaatgctttttcagtttcctagataaacttgcagcacaaatttgattctctttaatattttctctagggtgatcagcccatgacctaaacctccagacaaaataaaacggaaaatttgctagaatcaagaatgatggatccatgttcagttggagtccagcttcgtactacaaatgagtgccataaaacctactatactcgtcacacaggttttaagactttgcaagaattgtcatcaaatgatatgcttttacttcaacttagaactggaatgacactttctgggaacaatacaatttgctttcatcatgtaaaaatttacattgacagatttgaggatttacagaagtcatgttgtgacccatttaacatacacaagaaattagccaaaaaaaatttgcatgtaattgacttagatgatgccacttttctgagtgctaaatttggaagacagcttgtacctggttggaagctttgtccaaaatgcacacagataatcaatggaagtgtggatgttgatactgaagaccgccagaaaaggaaacctgagtcagatggaagaactgctaaagctttgaggtcattacaatttacgaatccaggaaggcaaactgaatttgctccagaaactggt

SEQ ID NO: 105768 - DNA, 1914 bp, Homo sapiens
  Payload ID: 736
  Gene Symbol: ARL14EPL
  Gene Name: ADP-ribosylation factor-like 14 effector protein-like
  Uniprot ID: P0DKL9
  ENST ID: ENST00000601302
  CDS Start-End: 285-743
catccagtgggccgaagcaggagggcaagagatttcatcgcaccactcagaacagtgcacagtttgaaacttaagagttgtttatttctggaattttccatctacgtcacaatacctgtgttattgccctcacttcatcccatcacgtagccatttgaccattttacatcatcataagaagcagtgtgtgtaaagaaggaagaatggagttctaaaaactcagagtcttcttaatcctgcttaagagaggtttatgatgctaaggactgtcaaagtgatcagagatgaatgaacaatcagagaaaaacaattccattcaagagagacacacagatcatagttttcctgagaagaactgtcaaattggacagaaacaactgcaacaaatagagcggcagttaaaatgcttggcatttcgaaaccctggaccacaggtagcagactttaatcctgaaacaaggcagcagaaaaagaaagcccggatgtcaaagatgaatgaatatttttctaccaaatacaaaataatgaggaagtatgacaaaagtggcaggctcatctgtaatgacgctgatctgtgtgattgtctagagaagaactgcctgggctgcttctacccatgcccgaagtgtaactccaacaagtgtgggcccgagtgccgctgcaaccgacggtgggtttacgatgccatcgtcactgagtcaggagaggtcatcagcacgctgccgtttaatgttcctgactaggtgctcttgtatatggactgatttgtttcttcttcttacacatttaagttgacctctttcttttgggtgaattttagggcttgggggaaatatcgaaaaaacatactgaagactcatgttctgtcaagccccagaacaatgtagaatgggcaataattctgtaaccttcttaactgtgtcaacaattttcaagtcccttaacttgcaaccaaagaatgtaacaatggagggatcagcatttctcatcagcaccctcatctctactctgccttcaaattaaaactctcttccctctttgctgatatctgagaaaatgtagctttaagattttcaaaactctgtagttgagagcttttcttacatagaacatagaatcttaaatttataatatctagttgtccttagaatcttatacatcactagctgtaaatcagaattgccatttggattttgaagaaaaactgtgactttgcactgtatacccatagcctcatttttttattgttcatgttttaataacattaaaatgaaatttagtaatacttggtagtatttttaatcattaaaatttgtattgtacttgtaaaattgaaaagttaggaatttattatcctaaaagccaggagtttacatatttttgatttcagaagcagtatttcaggatttgtttttcatagagagaaaacaagttatacaaaaatgattttctgtatgtttgctaattgagtgtgttgataagcaattgactagataaatgatgtagtcttttcaactttgatacatcatcagagctataaaatattgaattcagctttctttgaattcatttttttatgacagtcttttttttaaccctaagtcaatggttctcattcatgagaattgcctagagaacttgtcaaaacatagatttttgcagccccacattcagaatctgggacagggctcaaccatctgttccacgttcccaggtgatgttgatgctgctgatgtggggaccacactttgagaaccacttctctaaattattttagatacataatgtaaggaagtatttaaacctcattgactatgatactgccactgcacaaagctggaagtatttaaataaagtaacgtaataaaaatttaaaagtaaataaaagcatttaagttttaaaataaatttgaa

SEQ ID NO: 105769 - DNA, 642 bp, Homo sapiens
  Payload ID: 736
  Gene Symbol: ARL14EPL
  Gene Name: ADP-ribosylation factor-like 14 effector protein-like
  ENST ID: ENST00000634632
  CDS Start-End: 1-459
atgaatgaacaatcagagaaaaacaattccattcaagagagacacacagatcatagttttcctgagaagaactgtcaaattggacagaaacaactgcaacaaatagagcggcagttaaaatgcttggcatttcgaaaccctggaccacaggtagcagactttaatcctgaaacaaggcagcagaaaaagaaagcccggatgtcaaagatgaatgaatatttttctaccaaatacaaaataatgaggaagtatgacaaaagtggcaggctcatctgtaatgacgctgatctgtgtgattgtctagagaagaactgcctgggctgcttctacccatgcccgaagtgtaactccaacaagtgtgggcccgagtgccgctgcaaccgacggtgggtttacgatgccatcgtcactgagtcaggagaggtcatcagcacgctgccgtttaatgttcctgactaggtgctcttgtatatggactgatttgtttcttcttcttacacatttaagttgacctctttcttttgggtgaattttagggcttgggggaaatatcgaaaaaacatactgaagactcatgttctgtcaagccccagaacaatgtagaatgggcaataattctgtaaccttcttaactgtgtcaac

SEQ ID NO: 105770 - DNA, 578 bp, Homo sapiens
  Payload ID: 737
  Gene Symbol: ARL15
  Gene Name: ADP-ribosylation factor-like 15
  ENST ID: ENST00000507646
  CDS Start-End: 98-574
gctgttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagaaaattcaggactgaaaaa

SEQ ID NO: 105771 - DNA, 2486 bp, Homo sapiens
  Payload ID: 737
  Gene Symbol: ARL15
  Gene Name: ADP-ribosylation factor-like 15
  Uniprot ID: Q9NXU5
  ENST ID: ENST00000504924
  CDS Start-End: 95-709
gttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatgtagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggc

SEQ ID NO: 105772 - DNA, 3248 bp, Homo sapiens
  Payload ID: 737
  Gene Symbol: ARL15
  Gene Name: ADP-ribosylation factor-like 15
  ENST ID: ENST00000502271
  CDS Start-End: 555-632
attttcgctgttgctggctttttcaggagctgctcgctcgcagccagagacgctgctttttttttccgggttcggagccgttccggatgctttaggctgccggatgtctgatctccgaataactgaggcgtttctgtacatggattatctgggaaaaaaaatgctcctttcattccaagtttgactccagattttgctgaatggattagagttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatgtagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggccttgctttccctgcaagttcattaaatgtagaatgttgtctttttaagacaccgtggctgagtgctcctaagccatctgttaaatgacttcccgtggtctgcgtgtgtgtgttcatgtgtgcgccagtgatgggcctctcctcaaacccacgactgtctgcagcgtctcagccgtcagaatgaaaacattatcaatcagtacccaacaacagctgtttttgacaagtttctgtctgacgcctaatgctttacaactgtcaataaggctccctctttgtctagcaggtcggagctcgctgtcttgctgcttccgcgcggcatcctgtccttgtaaccctagaatttgccatgttttggaaatccacgtgggggcggggtggggcctgaacgggtggggatgggtgggtgggtggtggggtgggtgggatggctgggggtgggagtgtaagtcccttttcctactttcatgtaaagtgccacaggtgtcttggtttgcatattcaaatattatataggaaaaacagtctgttatgtatttcttcacctagcttcttgtaatatttatggacgtttccagtttttgtaccttcttagctaaagcagttgcctttttgtaatggcaattaatttatatgataaaactttgtatccactgtagttgacagtattggttgctaattaactgccatattgccctgtctttctattaaaaaaatactgtacctgtacttagaggctaacagattcatgtggacatttaccaggcaagaccaacttgtattgtccatgatttctacgatttccactatcttcaaatgaaaaataaacgctgagtagaa

SEQ ID NO: 105773 - DNA, 2486 bp, Homo sapiens
  Payload ID: 737
  Gene Symbol: ARL15
  Gene Name: ADP-ribosylation factor-like 15
  ENST ID: ENST00000620747
  CDS Start-End: 95-709
gttgctggctttttcaggagctgctcgctcgcagccagagacgctgctttttttttccgggttcggagccgttccggatgctttaggctgccggatgtctgatctccgaataactgaggcgtttctgtacatggattatctgtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggttttagtattaaagcagtgccattccagaatgccatcttgaatgtaaaagaacttggaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagagctcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaaggtttagcacctttgatcttttctaaatcaggaaaaaaatctatgcatattgaggttcacagatgaaatattctttggcatactttgtagactttgaccacttaaaatactaagtggccaaatgataaaaaaaactgctccctgcacatgagtgtaaaaacatgtttgtaattttaagtaaaatggactgatacccaaataccacagactcacactatattacagaatgatgtaatacctggtaattctccagaagatagacttcagacccttaatgccatttaaatgtagtttttgtggtttaatcttatgagtagattgtaatgaaatcattacctttgaaacatcaaacacttctttaagctttttttttttaatgtcatgaatcaggaaggatacatagtgattcgtatacaattttgtctgcagcattcttgaatatttttaacactgtgtaatccctgagcagcacaaaacttttattccgatgaccagttacacaattcctgtttttattttgtcctgttgtgctcatcttctatgaaaaataaatgattattaggc

SEQ ID NO: 105774 - DNA, 1227 bp, Homo sapiens
  Payload ID: 738
  Gene Symbol: ARL16
  Gene Name: ADP-ribosylation factor-like 16
  Uniprot ID: Q0P5N6
  ENST ID: ENST00000397498
  CDS Start-End: 100-693
gtcttccgctctcccgctaacgctgcgcgctaattggacgcgcccttggaacaatgagccctaagaaccaatgagaagtccgaaggtgagaactatccaatgagagtggccggtgggcgggccttgagccgcggcgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgtccccagactgga

SEQ ID NO: 105775 - DNA, 869 bp, Homo sapiens
  Payload ID: 738
  Gene Symbol: ARL16
  Gene Name: ADP-ribosylation factor-like 16
  ENST ID: ENST00000573392
  CDS Start-End: 81-362
ggggcgcggggggcacccggagtggggcggggactcaccctttagctgctcgggtccttgaccgcttcgcacagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaa

SEQ ID NO: 105776 - DNA, 763 bp, Homo sapiens
  Payload ID: 738
  Gene Symbol: ARL16
  Gene Name: ADP-ribosylation factor-like 16
  ENST ID: ENST00000573715
  CDS Start-End: 382-663
ccggggcgcggggggcacccggagtggggcggggactcaccctttagctgctcgggtccttgaccgcttcgcacaggtgggcaccaatcttactgacatcgtggcacagagaaagatcaccatccgggagcttggggggtgcatgggccccatctggtccagttactatggaaactgccgttctctcctggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataaccc

SEQ ID NO: 105777 - DNA, 768 bp, Homo sapiens
  Payload ID: 738
  Gene Symbol: ARL16
  Gene Name: ADP-ribosylation factor-like 16
  ENST ID: ENST00000570561
  CDS Start-End: 191-526
ggggggcacccggagtggggcggggactcaccctttagctgctcgggtccttgaccgcttcgcacaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagc

SEQ ID NO: 105778 - DNA, 751 bp, Homo sapiens
  Payload ID: 738
  Gene Symbol: ARL16
  Gene Name: ADP-ribosylation factor-like 16
  ENST ID: ENST00000574938
  CDS Start-End: 131-412
ggggggcacccggagtggggcggggactcaccctttagctgctcgggtccttgaccgcttcgcacaggtgagctcccgggatgggaaaggcgacctgggggagccgcccccgacacggcccacgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaa

SEQ ID NO: 105779 - DNA, 548 bp, Homo sapiens
  Payload ID: 738
  Gene Symbol: ARL16
  Gene Name: ADP-ribosylation factor-like 16
  ENST ID: ENST00000576914
  CDS Start-End: 1-147
gtgggcaccaatcttactgacatcgtggcacagagaaagatcaccatccgggagcttggggggtgcatgggccccatctggtccagttactatggaaactgccgttctctcctggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgaggtgggcgaatcacgaggtcaggagatggagaccatcctgactaacatgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatc

SEQ ID NO: 105780 - DNA, 694 bp, Homo sapiens
  Payload ID: 738
  Gene Symbol: ARL16
  Gene Name: ADP-ribosylation factor-like 16
  ENST ID: ENST00000576135
  CDS Start-End: 143-478
ccggggcgcggggggcacccggagtggggcggggactcaccctttagctgctcgggtccttgaccgcttcgcacaggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggca

SEQ ID NO: 105781 - DNA, 1181 bp, Homo sapiens
  Payload ID: 738
  Gene Symbol: ARL16
  Gene Name: ADP-ribosylation factor-like 16
  Uniprot ID: Q0P5N6
  ENST ID: ENST00000621051
  CDS Start-End: 100-693
gtcttccgctctcccgctaacgctgcgcgctaattggacgcgcccttggaacaatgagccctaagaaccaatgagaagtccgaaggtgagaactatccaatgagagtggccggtgggcgggccttgagccgcggcgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtctt

SEQ ID NO: 105782 - DNA, 1053 bp, Homo sapiens
  Payload ID: 738
  Gene Symbol: ARL16
  Gene Name: ADP-ribosylation factor-like 16
  ENST ID: ENST00000622299
  CDS Start-End: 11-532
gaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctg

SEQ ID NO: 105783 - DNA, 565 bp, Homo sapiens
  Payload ID: 739
  Gene Symbol: ARL17A
  Gene Name: ADP-ribosylation factor-like 17A
  ENST ID: ENST00000329240
  CDS Start-End: 140-565
gggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagggtcttgctccattgaccaggctggagtgcagtggcgtgatcttggctcactgcaacgtcctcttcccaagctcaggttcgtgagccacacatctccccacaccaagctcctccatacaagacctcggactgcatcacgtaaatgctttttcaggggcaaaatctag

SEQ ID NO: 105784 - DNA, 3945 bp, Homo sapiens
  Payload ID: 739
  Gene Symbol: ARL17A
  Gene Name: ADP-ribosylation factor-like 17A
  Uniprot ID: Q8IVW1
  ENST ID: ENST00000336125
  CDS Start-End: 100-633
gtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaatatctagagtaatttctgttttcctatctggggtagtgtaacataagaagaaatatatatttggtctctgcccccagttcctaacacaaagctcctaaaacccttggaaattcctgaatgatggcggtgctaagagcattgtcctttgttaatttatcatttttcttttctcctaggtgttttttcctttttaaacttttcttttaggttagggggtacatatgcacgttcgttatatagctaaacttgtgtcatgggggtttgttgtacagattatttcatcacccaggtaccaagcctagtacccaatagttttttctgctcctctccctcctcccaccctccaccctcaggtagggcccagtgtctgttgtttatgagttctcatcattttgctcccacttaaaagaacatacagtatttggttttctgttcctgtcttagtttgctgaggataatggcctctagctccatctgtgttcctgcaaaagacatgatctcgctgttttttatggttgcacatcttttgttctaacatttggtccttaaacctggttcctgacacagagctcctaaatcccttggaattttctgggtgatagaagcgtcctttgttctcatgaggtgactcttggtgggctccttatttggggactggtcaccaaaaagacctatggttggaagcgttgtgctgtcagccccattccccatcctctggcgtggggagtagagctggagctcaatcatgcctacgtgataaagcctccagaaaactccttaaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactgttttcctgggttccatgagctgttctagcaaatgttcaaacctgaggagggagttgtggggacctccaatttacagccagttggtcagatgcataggtgatgcttggccttgcacctggggtctgacatgcggatggtcctgtgtgactgagcccttaacctgtggagtctggtgctcactctgcttagggcttctcttgcctttttagtgtccttctaggcggcctttccttcctcttgtcagctcagaaaacttttcttccacttcccttcttctaaaccatcccttacatctactcctttccagccgaccaagagcagaaccacggctggttccactgccaccatgctgtcccacactgtctcctcaggatgtattcagatgtccagccctccccccagtctaggagccccccctttgaggaaagggatgctggcctagtcaactctttcccagcaccaggtacagcatctggcacgttccatctttttcatggactctccccaggcggcctgaccttccctcctctgaaccggtgcatttcttgtctgcatcatgtttgccctaatcagatatcaccttatttcctcttttaaaaaatgctttgtttctctggcaggcttcatcggaatcacaattttcattcatttagtaactgttgttgtttattctatgtatttttgcaggaggcctgaggtgggctgtgttctcctcctatggcagggcttcactctcctcctcctccgttggggcttcgctgtccctgggataagaataacaatgccaaggttttcattcttgaaaggagcaattaagcttctcaccccctcctcattttagatgggaactgtgagggccccatcatttacccagggtccctgttgaggatcttgtcctcattagatgacttcttgtgcagcttccatgcatgattatttattcttgtggcactgagaggtttgtacatatctttaaaccagagcggctgtccaaatgaggaaagtccatcctagaagatagaaagggaaatattaattttgcatgtcctctgctttccctggccacagcaatgaatcctccaatgtacctgactctcccttcgcgaagagcatcccctccatggcagaaatctgaaaatgcccctggggagacacatgcacaagacagtgagtgatgcagccgtttcccacgtatctcacaatgtacttctctggtcttattaggactaaatgagtatctcagtccataatcacagggagaaccaccaccacagaccacatacccggggtcttgaaaataattccatgcatgtgggactttcagaagctctccatgtctgcccagaagggccccacaatatactggggggactttgtatgtggctcagcatggagcaggggcaggattttcagtcccactcactcccttggccaagtgcccttgtgcagtgaacaaactgcacaaccatgctgggcagaagcattttatatcagtccccttcggacttagtctcacaggcatcatttgatgggggatgggagatgaagtggttcttcgttttctagatactttattctataagttggatcacctcaagcaaatgcgtgagtgcagctagccaagttctctatctcacagtcttcatatggctggctgtcgctgatgagtgagtgagctacgaaatcagcttaaagcacaacatgttatttttgaatttgaataaaataggaaaaggcagagtgcattgtgtgaccatggggtaagtaagacactctccctttctccttctcagttttcctgtcataaaaggacaaactactatctaaggtctccgtagttaaaattcttttttgttgttttttttttatttgagacagtttggctcattccccaggctggagtgcaatggtgctatcttggctccctgcaacctgcgcctcctgggctcaagcagttctcctgcctcagcctcccaagtagctgggattacacgcctgcgccaccacacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccaggggaaaaaaaaaagaaa

SEQ ID NO: 105785 - DNA, 798 bp, Homo sapiens
  Payload ID: 739
  Gene Symbol: ARL17A
  Gene Name: ADP-ribosylation factor-like 17A
  Uniprot ID: Q8IVW1
  ENST ID: ENST00000445552
  CDS Start-End: 88-465
aactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcaccggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatca

SEQ ID NO: 105786 - DNA, 491 bp, Homo sapiens
  Payload ID: 739
  Gene Symbol: ARL17A
  Gene Name: ADP-ribosylation factor-like 17A
  ENST ID: ENST00000570550
  CDS Start-End: 75-338
tcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagcctgatctagttgaatctgaagatgtggacctgctgatgaagagggctgactgtatctaacttagggtcttgcatgcagctggcacttaatacattttattgactgttttagataacattcaacagataattcctaataaaaactcttaaaagtagga

SEQ ID NO: 105787 - DNA, 581 bp, Homo sapiens
  Payload ID: 739
  Gene Symbol: ARL17A
  Gene Name: ADP-ribosylation factor-like 17A
  ENST ID: ENST00000573185
  CDS Start-End: 69-356
aggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttcttcagctgtcaaaaaagaagagactgctttgatcatgaaagatgatgggatgggatgcatcagtccatagctgtacaccccagtcacacagagtaggagtcagcaaacat

SEQ ID NO: 105788 - DNA, 2167 bp, Homo sapiens
  Payload ID: 739
  Gene Symbol: ARL17A
  Gene Name: ADP-ribosylation factor-like 17A
  ENST ID: ENST00000622488
  CDS Start-End: 140-406
gggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggttcgtgagccacacatctccccacaccaagctcctccatacaagacctcggactgcatcacgtaaatgctttttcaggggcaaaatctagagaatctgaaatggtgagcctttttcctttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggtttgaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctgttcaagttagaaagtaagatacaatgcacacaaagccaaattgtcatcattcagctcctattacaggggaactaagagctgcattgaaaattatttgcaaagcttgtaagtggttctgccacttattagccgtgtgaaccttagcaaattacctagcgtctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactagtattctaatagtgggataaataattcaatagggataaagcctggattttcctcttattctctcttagtgcttacattcttggcatgatatcgatgtgccatagacaagccaatatgtgagtgtactctatctgaataaagtatagcctttctacattgc

SEQ ID NO: 105789 - DNA, 798 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000434041
  CDS Start-End: 88-465
aactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacttcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatca

SEQ ID NO: 105790 - DNA, 743 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000450673
  CDS Start-End: 107-640
gcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaa

SEQ ID NO: 105791 - DNA, 2197 bp, Homo sapiens
  Payload ID: 740
  Gene Symbol: ARL17B
  Gene Name: ADP-ribosylation factor-like 17B
  ENST ID: ENST00000572991
  CDS Start-End: 1-335
gggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgcaatgaatcctccaatgtacctgactctcccttcgcgaagagcatcccctccatggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaatggtgagcctttttcctttttttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggtttgaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctattcaagttagaaagtaagacacaatgcgcacaaagccaaattgtcatcattcagctcctattacaggggaactaagagctgcattgaaaattatttgcaaagcttgtaagtggttctgccacttattagccatgtgaaccttagcaaattacctagcgtctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggatgaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatgtgagtgtactctatctgaataaagtatagcctttctaca

SEQ ID NO: 105792 - DNA, 581 bp, Homo sapiens; identical to SEQ ID NO: 105787
  Payload ID: 740
  Gene Symbol: ARL17B
  Gene Name: ADP-ribosylation factor-like 17B
  ENST ID: ENST00000575698
  CDS Start-End: 69-356

SEQ ID NO: 105793 - DNA, 1140 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000570618
  CDS Start-End: 107-484
gcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaagttgccaggtgcggtggctcacgcctgtaatcccagcactttgggaggccaaggcgggcggatcatctgaggtcgggagttcgagaccagcctgaccaatatggagaaaccccgtctctaccaaaaatacaaaattagctgtgcatggtggcctatgcctgtaatcccagctacttgggaggctgaggcaggagaatcgctggaacccgggaggcagaggttgtattgagccgagattgagccattgcactccagcctgggtgacaagaacaaaactccgtttcaaaaacaaaaaaaggaagaaaagaaaaagaaaaaagaaaagtcaacgacaccattatcttgtcaagatcaaatggttttattattgtggcagaagcgagaaaattttgtttattaaaaaaaaaaaa

SEQ ID NO: 105794 - DNA, 491 bp, Homo sapiens; identical to SEQ ID NO: 105786
  Payload ID: 740
  Gene Symbol: ARL17B
  Gene Name: ADP-ribosylation factor-like 17B
  ENST ID: ENST00000571246
  CDS Start-End: 75-338

SEQ ID NO: 105795 - DNA, 731 bp, Homo sapiens
  Payload ID: 740
  Gene Symbol: ARL17B
  Gene Name: ADP-ribosylation factor-like 17B
  ENST ID: ENST00000575960
  CDS Start-End: 61-606
gagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttctt

SEQ ID NO: 105796 - DNA, 2167 bp, Homo sapiens
  Payload ID: 740
  Gene Symbol: ARL17B
  Gene Name: ADP-ribosylation factor-like 17B
  ENST ID: ENST00000612181
  CDS Start-End: 140-406
gggtgattggttggttgctgttcctgcccccacgcctgtcgtggtttagctgaactgagctgaattcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggttcgtgagccacacatctccccacaccaagctcctccatacaagacctcggactgcatcacgtaaatgctttttcaggggcaaaatctagagaatctgaaatggtgagcctttttcctttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggtttgaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctcttcaagttagaaagtaagatacaatgcacacaaagccaaattgtcatcattcagctcctattacaggggaactaagagctgcattgaaaattatttgcaaagcttgtaagtggttctgccacttattagccatgtgaaccttagcaaattacctagcatctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatgtgagtgtactctatctgaataaagtatagcctttctacattgc

SEQ ID NO: 105797 - DNA, 741 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000617818
  CDS Start-End: 140-517
gggtgattggttggttgctgttcctgcccccacgcctgtcgtggtttagctgaactgagctgaattcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgctggtctcgaactcctggcttgaagtgatccttctgtcttggcctcccgaaatgctgagatttcaagcgtgagtcatcatgtctggtctcacagctcagtttttaacatatgtatgaaatatcaactgtgtttggttcaaaggactttatgatcttacagataggaactaaggaataataacataagaaataaaaaatgtgg

SEQ ID NO: 105798 - DNA, 565 bp, Homo sapiens; identical to SEQ ID NO: 105783
  Payload ID: 740
  Gene Symbol: ARL17B
  Gene Name: ADP-ribosylation factor-like 17B
  ENST ID: ENST00000622877
  CDS Start-End: 140-565

SEQ ID NO: 105799 - DNA, 565 bp, Homo sapiens; identical to SEQ ID NO: 105783
  Payload ID: 740
  Gene Symbol: ARL17B
  Gene Name: ADP-ribosylation factor-like 17B
  ENST ID: ENST00000616412
  CDS Start-End: 140-565

SEQ ID NO: 105800 - DNA, 747 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000622165
  CDS Start-End: 111-644
ccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttccttccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaa

SEQ ID NO: 105801 - DNA, 798 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000613440
  CDS Start-End: 88-465
aactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatca

SEQ ID NO: 105802 - DNA, 798 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000615623
  CDS Start-End: 88-465
aactgagctgaattcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatca

SEQ ID NO: 105803 - DNA, 743 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000618729
  CDS Start-End: 107-637
gcctgtcgtggtttagctgaactgagctgaattcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcccctccagtgataagcactaattgcctatatacaacccttttttgtttgaaa

SEQ ID NO: 105804 - DNA, 565 bp, Homo sapiens
  Payload ID: 740
  Gene Symbol: ARL17B
  Gene Name: ADP-ribosylation factor-like 17B
  ENST ID: ENST00000620856
  CDS Start-End: 140-565
gggtgattggttggttgctgttcctgcccccacgcctgtcgtggtttagctgaactgagctgaattcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagggtcttgctccattgaccaggctggagtgcagtggcgtgatcttggctcactgcaacgtcctcttcccaagctcaggttcgtgagccacacatctccccacaccaagctcctccatacaagacctcggactgcatcacgtaaatgctttttcaggggcaaaatctag

SEQ ID NO: 105805 - DNA, 731 bp, Homo sapiens
  Payload ID: 740
  Gene Symbol: ARL17B
  Gene Name: ADP-ribosylation factor-like 17B
  ENST ID: ENST00000626686
  CDS Start-End: 61-606
gagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttccttccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttctt

SEQ ID NO: 105806 - DNA, 581 bp, Homo sapiens; identical to SEQ ID NO: 105787
  Payload ID: 740
  Gene Symbol: ARL17B
  Gene Name: ADP-ribosylation factor-like 17B
  ENST ID: ENST00000630826
  CDS Start-End: 69-356

SEQ ID NO: 105807 - DNA, 491 bp, Homo sapiens
  Payload ID: 740
  Gene Symbol: ARL17B
  Gene Name: ADP-ribosylation factor-like 17B
  ENST ID: ENST00000626738
  CDS Start-End: 75-338
tcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagcctgatctagttgaatctgaagatgtggacctgctgatgaagagggctgactgtatctaacttagggtcttgcatgcagctggcacttaatacattttattgactgttttagataacattcaacagacaattcctaataaaaactcttaaaagtagga

SEQ ID NO: 105808 - DNA, 2194 bp, Homo sapiens
  Payload ID: 740
  Gene Symbol: ARL17B
  Gene Name: ADP-ribosylation factor-like 17B
  ENST ID: ENST00000628199
  CDS Start-End: 1-335
gggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttccttccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgcaatgaatcctccaatgtacctgactctcccttcgcgaagagcatcccctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaatggtgagcctttttccttttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggtttgaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctgttcaagttagaaagtaagatacaatgcacacaaagccaaattgtcatcattcagctcctattacaggggaactaagagctgcattgaaaattatttgcaaagcttgtaagtggttctgccacttattagccgtgtgaaccttagcaaattacctagcgtctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccacagacaagccaatatgtgagtgtactctatctgaataaagtatagcctttctaca

SEQ ID NO: 105809 - DNA, 712 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000626328
  CDS Start-End: 95-472
ttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgtctcacaacaacaaactgcagtctacagcttcctaaagttcagcatgttaacctaacataaaacacagcaagaatcttgttgcctgaactattttaaattaaggagccagatctttttagtgaggctatcctgacaagacttgatctaactttgtttttatcggtcataacagtccaattatattattggccaattttgtccaatggacaagaaaaaa

SEQ ID NO: 105810 - DNA, 1140 bp, Homo sapiens
  Payload ID: 740
  Gene Symbol: ARL17B
  Gene Name: ADP-ribosylation factor-like 17B
  Uniprot ID: Q8IVW1
  ENST ID: ENST00000634170
  CDS Start-End: 107-484
gcctgtcgtggtttagctgaactgagctgaattcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcactggcacaaatgatgaggcatctcctggaagcttaacttcttatccatcccatctcttggacagatgatgccagttaattactttgaatgtctcacaacaacaaactgcagtctacagcttcctaaagttcagcatgttaacctaacataaaacacagcaagaatcttgttgcctgaactattttaaattaaggagccagatctttttagtgaggctatcctgacaagacttgacctaaactttgtttttattggtcataacagtccaattatattattggccaattttgtccaatggacaagaaaaaagcaaagttgccaggtgcggtggctcacgcctgtaatcccagcactttgggaggccaaggcgggcggatcatctgaggtcgggagttcgagaccagcctgaccaatatggagaaaccccgtctctaccaaaaatacaaaattagctgtgcatggtggcctatgcctgtaatcccagctacttgggaggctgaggcaggagaatcgctggaacccgggaggcagaggttgtattgagccgagattgagccattgcactccagcctgggtgacaagaacaaaactccgtttcaaaaacaaaaaaaggaagaaaagaaaaagaaaaaagaaaagtcaacgacaccattatcttgtcaagatcaaatggttttattattgtggcagaagcgagaaaattttgtttattaaaaaaaaaaaa

SEQ ID NO: 105811 - DNA, 731 bp, Homo sapiens; identical to SEQ ID NO: 105795
  Payload ID: 740
  Gene Symbol: ARL17B
  Gene Name: ADP-ribosylation factor-like 17B
  ENST ID: ENST00000633026
  CDS Start-End: 61-606

SEQ ID NO: 105812 - DNA, 581 bp, Homo sapiens; identical to SEQ ID NO: 105787
  Payload ID: 740
  Gene Symbol: ARL17B
  Gene Name: ADP-ribosylation factor-like 17B
  ENST ID: ENST00000632650
  CDS Start-End: 69-356

SEQ ID NO: 105813 - DNA, 2193 bp, Homo sapiens
  Payload ID: 740
  Gene Symbol: ARL17B
  Gene Name: ADP-ribosylation factor-like 17B
  ENST ID: ENST00000632007
  CDS Start-End: 1-335
gggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgcaatgaatcctccaatgtacctgactctcccttcgcgaagagcatcccctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaatggtgagcctttttcctttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggtttgaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctcttcaagttagaaagtaagatacaatgcacacaaagccaaattgtcatcattcagctcctattacaggggaactaagagctgcattgaaaattatttgcaaagcttgtaagtggttctgccacttattagccatgtgaaccttagcaaattacctagcatctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatgtgagtgtactctatctgaataaagtatagcctttctaca

SEQ ID NO: 105814 - DNA, 491 bp, Homo sapiens; identical to SEQ ID NO: 105786
  Payload ID: 740
  Gene Symbol: ARL17B
  Gene Name: ADP-ribosylation factor-like 17B
  ENST ID: ENST00000633542
  CDS Start-End: 75-338

SEQ ID NO: 105815 - DNA, 979 bp, Homo sapiens
  Payload ID: 741
  Gene Symbol: ARL2
  Gene Name: ADP-ribosylation factor-like 2
  Uniprot ID: P36404
  ENST ID: ENST00000246747
  CDS Start-End: 96-650
gactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 105816 - DNA, 795 bp, Homo sapiens
  Payload ID: 741
  Gene Symbol: ARL2
  Gene Name: ADP-ribosylation factor-like 2
  Uniprot ID: P36404
  ENST ID: ENST00000533729
  CDS Start-End: 17-490
gggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgt

SEQ ID NO: 105817 - DNA, 830 bp, Homo sapiens
  Payload ID: 741
  Gene Symbol: ARL2
  Gene Name: ADP-ribosylation factor-like 2
  Uniprot ID: P36404
  ENST ID: ENST00000529384
  CDS Start-End: 29-583
cggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 105818 - DNA, 2130 bp, Homo sapiens
  Payload ID: 742
  Gene Symbol: ARL2BP
  Gene Name: ADP-ribosylation factor-like 2 binding protein
  Uniprot ID: Q9Y2Y0
  ENST ID: ENST00000219204
  CDS Start-End: 271-762
aggaggcggggcgccgcgcccctccggcagtcaccgaggcccggacctgcggcgtcggcggcgcgcgcagagggccaggcgggcgtagaggccggaccgacgcgtggcggcagagggtatccaaggccggacctggcgcgcaggcgctgacccgacctggcagtgagctggccgcggccttggctgagaggccttaaccccgccgggcggccgcgccctgcatgcgagttgggccgcgggcggggttggagcctactcggggcgactgcgatggacgccttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaa

SEQ ID NO: 105819 - DNA, 1416 bp, Homo sapiens
  Payload ID: 742
  Gene Symbol: ARL2BP
  Gene Name: ADP-ribosylation factor-like 2 binding protein
  ENST ID: ENST00000563234
  CDS Start-End: 1-514
cttagaaggagagagctttgcgctgtctttctcctccgcctctgatgcagaatttgatgctgtggttggatatttagaggacattatcatggatgacgagttccagttattacagagaaatttcatggacaagtactacctggagtttgaagacacagaagagaataaactcatctacacacctatttttaatgaatacatttctttggtagaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcacttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtcccactgtttctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaa

SEQ ID NO: 105820 - DNA, 547 bp, Homo sapiens
  Payload ID: 742
  Gene Symbol: ARL2BP
  Gene Name: ADP-ribosylation factor-like 2 binding protein
  ENST ID: ENST00000562023
  CDS Start-End: 19-390
ctactcggggcgactgcgatggacgccttagaaggagagagctttgcgctgtctttctcctccgcctctgatgcagaatttgatgctgtggttggatatttagaggacattatcatggaaaaatacattgaagaacagctgctgcagcggattcctgagttcaacatggcagccttcaccacaacattacagcaccataaggatgaagtggctggtgacatattcgacatgctgctcaccttcacagattttctggcttttaaagaaatgtttttggactacagagcagaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccc

SEQ ID NO: 105821 - DNA, 3844 bp, Homo sapiens
  Payload ID: 743
  Gene Symbol: ARL3
  Gene Name: ADP-ribosylation factor-like 3
  Uniprot ID: P36405
  ENST ID: ENST00000260746
  CDS Start-End: 133-681
accccgccccgtattgctgctcagctcctcagctgtgcgtgcgagggacgtcgggggcggcgccgcagcagttgcccctggtaacgggggaggcagcaggaggaggaggaggaggagggactcggcgggaggatgggcttgctctcaattttgcgcaagttgaaaagtgcaccagaccaggaggtgagaatacttctcctgggcttggataatgctggcaagaccactcttctgaagcagcttgcatctgaagacatcagccacatcacacctacacagggtttcaacatcaaaagtgtacaatcacaaggttttaaactgaatgtatgggacattggtggacagaggaaaatcagaccatactggaagaattattttgaaaataccgatattcttatatatgtaatcgacagtgcagacagaaaaagatttgaagagacgggtcaggaactagcggaattactggaggaagaaaaactaagttgtgtgccagtgctcatctttgctaataagcaggatttgctcacagcagcccctgcctctgaaattgcagaaggactgaacctgcataccatccgcgaccgagtctggcagatccagtcttgctcagctctcacaggagagggcgttcaggatggcatgaactgggtctgcaaaaatgtcaatgcaaagaagaaataaaatctagacgaatggagatgcaggagctgcgggagccgaattcggtcctgaaaaacactaatttgctgctttctgaccaaatgtttttccatctgtgtacagctccagctgtttgaagagagggaacaacacggtttagaaagaatccccattccagcagtagatttaactgatctctgaggttcagtatcatttttcaaataaaggaattatattatttcctctgcataattgaaatagtattaaatgtctcaaagcacatgattagaaaatgagatcttttaaatgagcaagagattgcattgcagtttagacaattccagtgggcttttttttcctctcaaaaaaaaaaaaagaaaaagaaaaagaggaagaagcagctttgctgagttcatttatttactgacccgtcccttgcattccctccatggttttgaaaccacagacagtgtttgctggtgctgtcagtgatttttaccgtcactagcccagccaggcttcagtctgtccgacaggaagctgctgggtgggggtggggggagaaaaggcagataattaaaccatctcatcgtcttgcaggtcggagactacgtatgtaatcctcactctttggacagaaaaaaaaaaaaaagtctttcttgcagacaagtcactacagaaacataccccatcccacccacccctgcctctgccccagccagccacacagagaagcaaattcttatgacttttgactgtaatgacatctggaatgtaaggagaggtgggaggtttaattccagaaaaattacaaggtccttaaaaagctctcacatcgagggctcaggctagcgtaaacaggctttctccagctcagtggagcagtgagcagccgactctgagattagctggcttctccacggccgtcctatagacaggatttctaaagctcaaagaattctgtgtttaaacgatcacaataggccgctgctatcagattttagaaataaatgcagctttaccatgaacctgctccactgagaaaagccaggcagatcgatttttagatcaatttttacagtgctggcaacttggtggtgtgggatgctcctggatggagagggtttgctgctggggaggacatgggtgtgtgtgtgactgcaggggtcgtgtccaaggaatcaagagtcaccccagctgctgggctcctctgcctctctgcagcagaatgtccgtcctctgttgattgattggagaggaatagcagaacatttctcctgcccctcgttgcaaaacgagcttgtttccctgaacctcagaaatcctcagcttcaaacatggggaaacaggccagagcattgcccggctcctgaattaaactctgttctggtgcctgagctcaggggttttcagagaatgaataagagactgtccagtgactggtgggtccctgggggccagctgccttctcatcctgggaggtggcccttcccaagcccatcagggcgtgtgagcagactgaaggggccgctgcagcccctggccctcaatacccagctgcttctggctaagagtgcagcagagactgaggcatagccagcttcaaaagcgatctgacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatatgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaa

SEQ ID NO: 105822 - DNA, 1147 bp, Homo sapiens
  Payload ID: 744
  Gene Symbol: ARL4A
  Gene Name: ADP-ribosylation factor-like 4A
  Uniprot ID: P40617
  ENST ID: ENST00000356797
  CDS Start-End: 226-828
ggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtg

SEQ ID NO: 105823 - DNA, 1296 bp, Homo sapiens
  Payload ID: 744
  Gene Symbol: ARL4A
  Gene Name: ADP-ribosylation factor-like 4A
  Uniprot ID: P40617
  ENST ID: ENST00000396662
  CDS Start-End: 372-974
ggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtct

SEQ ID NO: 105824 - DNA, 3212 bp, Homo sapiens
  Payload ID: 744
  Gene Symbol: ARL4A
  Gene Name: ADP-ribosylation factor-like 4A
  Uniprot ID: P40617
  ENST ID: ENST00000396663
  CDS Start-End: 533-1135
tggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaa

SEQ ID NO: 105825 - DNA, 1144 bp, Homo sapiens
  Payload ID: 744
  Gene Symbol: ARL4A
  Gene Name: ADP-ribosylation factor-like 4A
  Uniprot ID: P40617
  ENST ID: ENST00000396664
  CDS Start-End: 223-825
ggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtg

SEQ ID NO: 105826 - DNA, 840 bp, Homo sapiens
  Payload ID: 744
  Gene Symbol: ARL4A
  Gene Name: ADP-ribosylation factor-like 4A
  Uniprot ID: P40617
  ENST ID: ENST00000404894
  CDS Start-End: 181-783
agctgcttggagagctaagctggaagggtgcttatccctgcgtagaaacgcctgccaatgctttctcatttggacccagactccagatcgggagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaa

SEQ ID NO: 105827 - DNA, 845 bp, Homo sapiens
  Payload ID: 744
  Gene Symbol: ARL4A
  Gene Name: ADP-ribosylation factor-like 4A
  ENST ID: ENST00000439721
  CDS Start-End: 694-845
gaagggatcccacttcggggaggatgggcttatcccggcgggcgcgccaggtgggatctctagcgcctcaggggcccgcgcggcaacagccggcaccctcgggcccgcggacaaagggttaacgcgttggcagtgactgcgggccccggatgtgagagccttggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctac

SEQ ID NO: 105828 - DNA, 3385 bp, Homo sapiens
  Payload ID: 745
  Gene Symbol: ARL4C
  Gene Name: ADP-ribosylation factor-like 4C
  Uniprot ID: P56559
  ENST ID: ENST00000339728
  CDS Start-End: 15-620
cgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 105829 - DNA, 4013 bp, Homo sapiens
  Payload ID: 745
  Gene Symbol: ARL4C
  Gene Name: ADP-ribosylation factor-like 4C
  Uniprot ID: P56559
  ENST ID: ENST00000390645
  CDS Start-End: 468-1046
gactgtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgagataaaagaaagtgtgacgtcatggtcactggtactcaggcacttcacagtttacttgaaagaggctttggaaaatagataaagtgaaagaagaataaatacatatttttaataatgtaattttaaaaatcctttataatcaggactgagtcttggtttgcagaagctgtcacttaccctgaaacacagtatcaaaagggaaacttaaaacatactgtttgatttttttatttcctcttacaatccatgttttcaggtagaattatgactttccccccattgttacacatttctttacaaaggaggcctgtagaaattggacacgatcatgcttgagcatgtgagttagtcaaattatgagtccctgcctattgtccattacacaccgaatgttaatttaagaaccagaggcagaagttctggcttcctgcttgaaacccaattcttatatgaaattttttaaaagcagaaacctagcagcccatctgctttttctcttttgtcggtgtatttggtacccctccaatgctggtctttttgtagaaactcagtagagaaagtctagctaagcagtgttgaaaagcctgcaagatttcagtttacatatcgacagcatatccactgatttctaaatgggctggtcccatcatctgaagattctgtatagaattattaaaaaaaaaatccatctttctttattttcttcacatgcgacaatttcttaagcactttgacattttggtagttccacactattgagagaataatatatttattttgtgacattgcagatgccaaatactgtaaccttctcatgataacaatacttaggttcaagatcactgttcaaaccctgtcatgctttaaaactgatgcgagatgattttgttttttgcataatcaatacttaagggtgcaatcaactgttagtaattgtgcagtaaagtaaagccctgtggtgtatcaactactagttaagagtctcagttgatttctgtaatgtttgacctaataatagcccgtttcgtctctgacccaacagaggaagcacagatcaaatcaccttggagtggtcaccagggggacagggagccccccaccaatgtatcaatgggtgatttatgatgccttctgccctttggcgagtgaatgggtttcccataggggaagttggcctccctccgtgagctttggaaatgttttctaatagacacagggaggccagttctgtttcagagcaattatcttcccaaattctctgttctggtgttggaactgtgtgccctggtttctgttttcctttctactgctgtaattctctgtctcatcatccttctcttttgtttccatagccttttataatgcatatatgatgctgtgaacagaaataaattatttatacaatcaaa

SEQ ID NO: 105830 - DNA, 1612 bp, Homo sapiens
  Payload ID: 746
  Gene Symbol: ARL4D
  Gene Name: ADP-ribosylation factor-like 4D
  Uniprot ID: P49703
  ENST ID: ENST00000320033
  CDS Start-End: 208-813
gggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctat

SEQ ID NO: 105831 - DNA, 5326 bp, Homo sapiens
  Payload ID: 747
  Gene Symbol: ARL5A
  Gene Name: ADP-ribosylation factor-like 5A
  Uniprot ID: Q9Y689
  ENST ID: ENST00000295087
  CDS Start-End: 313-852
gcgtggtcgtcgccaccgcagccgcccgagaggagctgggggaggacggtggcccgcgaggctcgtcgcagacaacgcggcggcgatgtccgcgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggcccgggtgtctggagggggggggtccgctgcccgagaatgggaattctcttcactagaatatggagactgttcaatcaccaggagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagacattttgaattttaagagctttattatcagtttaaccctccctagttgaatgttattttcttcttgttccattaagtcagaatacaaatcagcacagatattcgaatgtttccaatattttaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccaacctcccaaatcgctgagctgcttgtttaaaaaaaaaaaaaaggaaaaggaaaaagcatgacattgtgtatcgattttttgttgttgaccaaaatcacacacatggaaacatgtaattcaacagagtgggaaagctagcagattcttggcttagtattactaataggcaggattgtacaatgagcaactatcagattattcctttcagtggttcttatggcatctaaattactgaataaattattaatccattaatcagtgaatcaaattatgattacaattatcaaatgaatgctcagcattaattgaaaactgttttgtgaaacatgtctacccagaaaagtagcattctataaatactattaaacaacttagctatattatttttaagtattaaattatatgtcaagcagttaaagtgaatttcagagtaaaagtaaggcatgtttctgagcaacattgataatttcttaatttgcaaatttcttcttattttggtacttggaatatagtgtgagattttttatttctaaattttgttgtatcttctattacataaatgcattgacaattataaaatgcaagtgttttttgaatgattttaagaatttggcttaaaaattgattgatacaacgtattatttgtactaagaagtaacttgacccaaaacaccttttatgtttgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagcataacatttaatatttgtccacatggttttacaaaagtaaatcttaaattactaagcttttcccatatgttctcgtactttctcaaatccctataaagaattacttgttatctattaaaaatctcctttacccaaatctgtattatggtttcgccagacaaatattatgtgatgtagcccagaaaatccacaccttttgtcctttttatgttttaatttgaataatcatgtgcttagtcccttggattactgccacatcagtttaacacgatatcagcacattcccttgtcatcatcaaggtgttggctcagatttattcttaattggatgtttaaagcatgtactaccttgttacagttggtttagtgtagtggattattgacatgacatcatgagaagatgtgtaattttataccacatttataaaacatgattttgttttctacccttcaaggtaaacattaaaaataaggtggtacttgtgtacttgtacataaaaccaaaattatagttgggaaaaaaataaatttatatatgaaaatgtcaaaatcattttaaaagtattattttcaaataaaatggagaagctggtgaaaagtcatattggcaatttttatgtagtttaagtggaattaagcagagggagatgcttttgggtttttaatatgccacttctgagtgaaaacatctcgtggagtcattgtgttcagctctgagaagaacaaagattcatagttctgtacatgtggctggatttaaatatcctgtttttgatactaattttgaaagtcatgtaacttcttttgatatctgggcaaaagtaaccatatgctataagcatttgaatatgtttaattttatcataatagcatctgtaaaagtacatcttacacattatatagagggttcttgtttgaaattttcagttctctttatcttcccagtacctcttggtcctcataatgggcaaaggatacaacgaaggcaggttgtataggggttatagtggggaagtggataggggattcattttcttatgtgacattttgccttaagaatataaaagtgctttagcactgatggctggcatttttaatataggcagtgaaagtgactttagaagcatgggatgaaatagagggaagaagagtttttattttctggcctttaaaaagtgcctagtaggtcatttgagacccagagaaatgcacagagcttgagcaaaggcatgaagtccctgacattgttttcctttttgtctcagcatatagtattaagatgcctagaaataggactctattgttccctcttgtataggcactttacatttcttgtcactacagcaaccacatacagtacagacaacctccaaacctgtttatattagtgtaaatagaaaatctatagacaactttctagttttctctggaggcatttttgggaatgtacgtgtaataggctctgctttgtatacaggagataataccacatcatcggttatctccaaactccagtcttctctcaactgcccagttgtatgttgtcatcaatcactttttcaaggctgggtagagacaagtttctcctcgtaactttgacctctcccactctccaaatgtaatctggacctcattgctttcaaggtcagcttccccatagctcaggtatcctttgctctcctgtatcttcatttactattagtgaagagatctctgtcctggaggttattctaaactttctttgtaactattgttatagacaatggtttccaaaccagtggtttctatgtagcttttctagttccttgctatcttctcaccactggcttgaggtagtgatttggactttgctcattagagagcattatcagagatgtggagtccatcagaagaccagcttgcagtgtgtatagcatatagatgccaatattagaattctttaaattatatttaacattttcatgcttcttaatttaacttcacatgttgggaagtagattcagaaagataggagaaatacccagactctaccacttccgtgagctactagttaggcatgggcaggattaagttttatgtgtattatcttcccactaccaagaatggttatgtttcacagaataccagttcagtttgatttggaaaaagatgccaaaccaaatttatatgtagtctataatctaagggcattcttgaaactattgcccacatcccattttttttttcatgtttacttacaaaacagagataaacattagatgtctaaaggagttagtaatgaaaagcctatccttaaaaaataaacctgttgaaatgggctttaaagacatcgaaataatcacttgtcatgcattgactgtaaatgcagatagagaaatatgtctttgaagctccacttacacaaaaataaaacttgtatatcatgctccctcaaagaatgtgcgatagattattttaagaccatgataatagagtaaaaaggaaagaaagccagaaattacaattttggatgctaaaaagtaactttctagttaaccctaaagtcctgtcagattgtgaagaaatgttccaggatacacttggattagttatgcagtatttcttatcaatgtctagcccttgtgtattgttctgaaaactaaagtttaaatctttatgctgttgcttgctagatatcctgttctttggtagaaaattcccatagtctgtactcaagaagtgcctaaaaatggatttgtgttgattttaagcccatctaataaattatatgtattttcta

SEQ ID NO: 105832 - DNA, 1076 bp, Homo sapiens
  Payload ID: 747
  Gene Symbol: ARL5A
  Gene Name: ADP-ribosylation factor-like 5A
  ENST ID: ENST00000458140
  CDS Start-End: 170-403
gcccgcgtggtcgtcgccaccgcagccgcccgagaggagctgggggaggacggtggcccgcgaggctcgtcgcagacaacgcggcggcgatgtccgcgagccagagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgagaagtaaaaagaagacctaagtagggcctagttggaaagtgaaaggagactgaatgaggagatgaccagagaagaaaggaattacagatgaagttgggagtttgagcaaggtactcagtagggtcaagaagagccaaacaggcaaaattctgcagagagacaaatggatcaaagagtgagaatgtgacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatggtaagtacaaagggagaggaagaca

SEQ ID NO: 105833 - DNA, 1268 bp, Homo sapiens
  Payload ID: 747
  Gene Symbol: ARL5A
  Gene Name: ADP-ribosylation factor-like 5A
  Uniprot ID: Q9Y689
  ENST ID: ENST00000446896
  CDS Start-End: 119-547
ggtggcccgcgaggctcgtcgcagacaacgcggcggcgatgtccgcgagccagagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccagtttgctttctcattagttttttccaaagtaagttattgaagctgtgattgacatttttctcataatgaatcctctcaggacattgtgtagcctatgatattctatattgagcgcattataccaataatcagaaaacattgctgaatcattttgtctttaaagaatcatctaatagggatgggaaggaatacaaaagttgtattaagtaaatgggatgaagctctcagttcagagatcaagatgattgggggataagaagaagaaaaacattcctgcaggactggtctgggcagaagaggagttgtggtaactagatatgaggagaaagagaggaaggaggcacagagcagttggagcttgctgcctggaagaatgacgttttagagacaaggtctgactgtgttgcccaggctggacttcaactcctcagtacaagtgatcctcctgcctgagcctcctgaatagctgggactacaggcctgcaccaccataccctgctctagttacacaaatcttaaaatgatgctgttatgttaattcaattaaga

SEQ ID NO: 105834 - DNA, 747 bp, Homo sapiens
  Payload ID: 747
  Gene Symbol: ARL5A
  Gene Name: ADP-ribosylation factor-like 5A
  Uniprot ID: Q9Y689
  ENST ID: ENST00000428992
  CDS Start-End: 146-574
gccgcccgagaggagctgggggaggacggtggcccgcgaggctcgtcgcagacaacgcggcggcgatgtccgcgagccagagcacaaagttatcattgttgggctggataatgcagggaaaactaccattctttaccaattttctatgaatgaagttgtacatacatctcctacaataggaagtaatgtagaagagatagtgattaataatacacgtttcctaatgtgggatattggtggccaagaatctcttcgttcttcctggaacacttactatactaacacagagtttgtaatagttgttgtggacagtacagacagagagaggatttctgtaactagagaagaactctataaaatgttagcgcatgaggacctaagaaaagctggattgctgatttttgctaataaacaagatgttaaagaatgcatgactgtagcagaaatctcccagtttttgaagctaacttctattaaagatcaccagtggcatatccaggcatgctgtgctctaactggcgagggattgtgccaaggacttgaatggatgatgtcacgacttaagattagatgatctctactgacctcttctcatagattttgtataaatgaagtgctggactttacctgaaagctgcaaaaattaatggtttagatatatttataataaactgatttaaactttttctataagaagaaaaattaagaccacttatttgaaaacaaagatgaagtctcaccttccag

SEQ ID NO: 105835 - DNA, 7196 bp, Homo sapiens
  Payload ID: 748
  Gene Symbol: ARL5B
  Gene Name: ADP-ribosylation factor-like 5B
  Uniprot ID: Q96KC2
  ENST ID: ENST00000377275
  CDS Start-End: 234-773
ggggactacgggtcggcgttgggctcagtgggctcgaaacaaagggctgtccggtggggattcgtcgcggcgccttctgagtggtcgggtcgaggcttctcggcctagcagtgccctcgctgcgcgatctcaggcgggttctcctcggctccgcgcagcccgcgccgcggtgggggacccggcgcagcggcacctgctgccgagggaccccgcggcccgccccggtgctcgtgatggggctgatcttcgccaaactgtggagcctcttctgtaaccaagaacacaaagtaattatagtgggactggataatgcagggaaaaccaccattctttaccaattcttaatgaatgaagtggttcatacttctccaaccataggaagcaatgttgaagaaatagttgtgaagaacactcattttcttatgtgggatattggtggtcaggagtctctgcgatcatcctggaacacatattactcaaatacagagttcatcattcttgttgttgatagcattgacagggaacgactagctattacaaaagaagaattatacagaatgttggctcatgaggatttacggaaggctgcagtccttatctttgcaaataaacaggatatgaaagggtgtatgacagcagctgaaatctcgaaatacctcacccttagttcaattaaggatcatccatggcacattcaatcctgctgtgctctcacaggagaagggttatgccaaggtctagagtggatgacctcccggattggtgtgagataacttttttgcttgaaagagactgctctatttattctgtgacatgaacattttttcctagtacctttggctgctaaggcagcagcatgtttaatttataacaacacaaacctctgagagcaacacttgaatcaagtgcagctgaactggaacataaaagattttttcttaactttttttttttaacacactaatcttcagttggatgaatgtaatgtataactatgttttcagcaacaattcttctgtttattctaattaatcagtgactgccttgtaagaaatgtttgtcatatgcgtgatgtcttctgaaatattcttataaccttaatgaccaattgctttcaattcttgaccagcactccctcccaaccagagaattactggtttgatagagtagtcttggaaaccatcaggtactgcctgcagacttctccagcactaaatatatttgttccctctataaaccattcatctttcggacagaacttactgtaaagaaagaaatctgcctagaggatatatgtaaggaagattccacatcatgagtacttgccttttaactttcccccacattactgttgagtcatggaataatgtttaagttgttatttgcatggaaattaagtaggctgtttatttatctaaaggaatcaagtccactcttctgcctgcaacatttgttcaaaaactaaccaaggtaaaatatttatttgaaagcccaactttgatgttaaatattcttgaataaatctgttattttaagaatatcacattattcaatgcatataaaactatcagaagttagtaaatcataccagcactaaaaataagacaattggaatatattttagcatcagtttacaaacaactttattatcaacagaaattttagctcttttctttgcaagatatatcacagctgctttgggcagtagctgaagccgaagtatgaacagtccattttgtttcttaaaatttgaagtcgtgtctgtcatagcatttttactaccagcagtatgttacttaaaaaactacatggctttccttgaatttatttgacggtattatgtaatagacttgaaacaattgccatctttgtagttatgccttgggttctaaaatgttataggaaactgctgaattgaatcctagcttttagaatattaataggagactcaaagttaatattcttaacaacttaaaattaaaaaaagtcataatctatcaaaagtttatttattggatggcattaaaacatttttgaggcagttgtctaatatgaacaataatctaaacaatatattccttaaattaagaggaaagacaagtgtcgtatttcgatcctgtttattcaaatgtgtgattttgctgaaatgaaagggataaaatgaatacttagagaataatacttcatttttgcagtactttttaattttgataaaaaagatacaaagttcataatatcaaaatatgtgttcaaaattggtattttaattttaatatttttgtaagttgatttaaattttgctcttttttcaggtgtgcttggtttattatatttagtcaagttaatttagtcgaatgtggtaacatttttctgatttatctttagttggagcacacccttgaactgaacagtggccaaaggaaagctttctgggctttggaaagtagttgtttaactttgttttaagccgttttcttagtgattctgtatcaagtagaggataagtgtagtttaacttagtttttaatataacccataatcaagaacatgagcgaaaagcagacataaatcgatatggatggtttgtggtgtgtgtgggatgtgggggaattaagaaaatgccatttacctaagcacagtttgcctgaatttctgcttggttgtgttgtttaccgtaagtactgagggtagtttccctaagtctgtcctgagaaaaagcatacttagtactcctgtatttgttcttatgaaatgactatctgccttcttgtatctagtaagattggctggctcaattttcttctgtcaaattatatggttattttttatattaccacatcagcattatattaaaagtgtttttaatagttgattgtattttgccaactactagtatagactcaaatttgctatttaatttttaaaatacaatttattttgtaaatcctttaaaaaatatttggttagttttggattagaaatgatttatgttagccatgtgttgaagatgaaattggcatcagtgtagacggtgctgattgggaaaagttcatgattaggaaattcatgtaagactttttaagagtattttttaggttttcactcaatctttcctgtcacagtaacgtgaaaactgattattctttactccaagagaatgttttaacccaagcaagtatctaatactagagcattggttctgacattcattgtaaatcagtgaactgtaagatactgtctaaaaaatgtacatttgtaattagtgcctttattcatattttgaaataagttcttagttttatattatacctgttctttagaagtcatgttagcagctaattatttcagtgatgaaataatttgtgttttatatcccccttcacctccatgtattggttagcacagtttatagtaagtgaaaagcaagggacccacctacattaccttcaggagactgttctaccttttaatttgaaaacaaggaaattaaattttaacagaaatcttttaagtatgttataaccaaagtgttcaattatccttgcaagttcaaatacagcatttttcttaattttgagcgtgtcatgtccttcatctttaaacccatcattcttattgaagcccatttgagaactcttagaattaatagaaccttttataagggaatatatggaatattttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacagctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggcaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaata

SEQ ID NO: 105836 - DNA, 540 bp, Homo sapiens
  Payload ID: 749
  Gene Symbol: ARL5C
  Gene Name: ADP-ribosylation factor-like 5C
  Uniprot ID: A6NH57
  ENST ID: ENST00000269586
  CDS Start-End: 1-540
atgggacagctgatcgccaagttaatgagcatcttcgggaaccaggagcacacggtcatcatcgtgggactggacaatgaaggaaagaccaccattctctaccggttcttgaccaatgaggtggtccatatgtgtcccaccattggcagcaacgtggaggagatcattctgccgaagacccacttcttcatgtgggacatagtgagacctgaggctctgagctttatctggaacacatactactccaacactgagtttatcatccttgtgattgacagcacggaccgggatcggctgctgaccactcgggaggagctatataaaatgctggcccatgaggctctacaggatgcttcagtcctgatatttgccaataagcaggacgtgaaggactccatgaggatggtggagatctcccatttccttactctcagcaccatcaaagaccactcgtggcatatacaaggctgctgtgccctcaccagggaagggctgcctgccagacttcagtggatggaatctcaggccgctgctaactga

SEQ ID NO: 105837 - DNA, 524 bp, Homo sapiens
  Payload ID: 749
  Gene Symbol: ARL5C
  Gene Name: ADP-ribosylation factor-like 5C
  ENST ID: ENST00000578912
  CDS Start-End: 1-300
aacacatactactccaacactgagtttatcatccttgtgattgacagcacggaccgggatcggctgctgaccactcgggaggagctatataaaatgctggcccatgaggctctacaggatgcttcagtcctgatatttgccaataagcaggacgtgaaggactccatgaggatggtggagatctcccatttccttactctcagcaccatcaaagaccactcgtggcatatacaaggctgctgtgccctcaccagggaagggttagtggctgccctacctggatctctagggcctggctgaaccaatggatgactgaccatcagaacccttctcctgcctctctcctgtgagaatctggttcacagttggctcctgggccaagccaatttggcatctccccacagagttttgctctttgttgcccaggctggagtgcaatggcatgacctcagctcactgtaacctccgcctcccaggttcaagcaattctcctgcctcagcctccggagtagctgggattacag

SEQ ID NO: 105838 - DNA, 1630 bp, Homo sapiens
  Payload ID: 750
  Gene Symbol: ARL6
  Gene Name: ADP-ribosylation factor-like 6
  Uniprot ID: Q9H0F7
  ENST ID: ENST00000335979
  CDS Start-End: 584-1144
aactcccatgatgctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagaaaaactgcctgctcttctaaattgtgtgtcccaaaatatttcattaacaagtatcaagtgataatccatggaaaagtgatggaaagtcacaatacaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataatgtgcc

SEQ ID NO: 105839 - DNA, 1590 bp, Homo sapiens
  Payload ID: 750
  Gene Symbol: ARL6
  Gene Name: ADP-ribosylation factor-like 6
  Uniprot ID: Q9H0F7
  ENST ID: ENST00000394206
  CDS Start-End: 544-1104
aactcccatgatgctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagatacagttgtcttggaagcctgttattgataaagttgctgcagcctcacatccttcaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataatgtgcc

SEQ ID NO: 105840 - DNA, 1705 bp, Homo sapiens
  Payload ID: 750
  Gene Symbol: ARL6
  Gene Name: ADP-ribosylation factor-like 6
  Uniprot ID: Q9H0F7
  ENST ID: ENST00000493990
  CDS Start-End: 584-1144
aactcccatgatgctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagaaaaactgcctgctcttctaaattgtgtgtcccaaaatatttcattaacaagtatcaagtgataatccatggaaaagtgatggaaagtcacaatacaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggttgctataacaaagtaccatagactgggtggcttataaacgacagaaatttatttcttacagctctggagctggaagtctgagatcagattaccagcatggttgggttctggtgagagccgtcttggttgcagactgccatcttcttgtatcctcacatggccaaaagaggacaagagaactctctggagtctgtttgataagagcatgaatcccattacatcttcacatggctcctcccaaagaccccacctcctaatatcatcacatgtcatcacatagggggttagaatttcaacatagaaattttgggagaacacaaacattcagtcagttgcaatacttaaggcaaattcatcttgcttataactctggtgcatgtgcattaaaatactattgcattgtaa

SEQ ID NO: 105841 - DNA, 894 bp, Homo sapiens
  Payload ID: 750
  Gene Symbol: ARL6
  Gene Name: ADP-ribosylation factor-like 6
  ENST ID: ENST00000462412
  CDS Start-End: 532-894
gctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagatacagttgtcttggaagcctgttattgataaagttgctgcagcctcacatccttcaagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgt

SEQ ID NO: 105842 - DNA, 4231 bp, Homo sapiens
  Payload ID: 750
  Gene Symbol: ARL6
  Gene Name: ADP-ribosylation factor-like 6
  Uniprot ID: Q9H0F7
  ENST ID: ENST00000463745
  CDS Start-End: 478-1038
atgatgctacgccgggaactgcccggctcctcgcaggaaataggcagctcaccctgccacctgtgcacacatttttcttcaatgtatagttcctcggcgcgcctctgaccttttcccggagctcttcaatcccagaagctatagcacaacggctgaatcgccaggacccccggggaggcgtggcttcaggaccggaagaagctcctgttgccaagggaacggtgcctgccaaggcgcctgctcagcgactgatgcacagactgctgcagaggctgccggttttcccaacttctagagacggctttgctcattaccaggcatccttcccatgtaggcatcgagaagaaggctgagggaccctcgcaccagatttccatcccggagaccgatacgagtgcgtccattcctgttgccagctcctgcgccctccggactaacctcaaaaaccagctggtttgtaaatatttgaatcacattatgggattgctagacagactttcagtcttgcttggcctgaagaagaaggaggttcatgttttgtgccttgggctagataatagtggcaaaacgacgatcattaacaaacttaaaccttcaaatgctcaatctcaaaatatccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataatgtgccaactagtgcgctttgtttatgctgaaaagaataatgctctgttagtatggtatttcgtgtcatactgtcaagcatttgtaaaccatctgagactaagttaagctgaatttatttattcagtgtatgttgaacatctctacaccaactagtcagacatagtcctaggcaatgatgttacgaggtaaataagacatatccttatcttcagagaacttaaaatttaatgagggataatttgagaacctttccatggatagtatctaattttatttcattggctgaatgaaaatattgcatcttcagattaagaggtataaagtaaattaatatttgactgttcagtaatcattactgacatcttgtttttcacttttaaatgcctccaatttaccatagcactttgttaaaataaattgtgacttttaactttttcatgaacataactgctacataaatgttctttagaattttagacatatctcaggcacacaaattattagttctcacaaattagagaacacttataattgtgaactctaaatagaaaccttcattttaatcactgagcaacagtatatagagcaatattgttgatcctgataaacactgcatataaagaaaaactgtaatatacaatatataccatctcaagtatgcttagctttgaaaatgatgaaaatagaaggcaaaagtaagtgagtaataaagatgttatagtaactgcagtagtggtacatgtttcacaaagattttaataaaagcacataaagctacaataaaagttctatattccagtttcttatagtccagaaatagcagtgatttggcatttggcaaattgaaagttacccagaaaattccaatggctcagcatcttagctagtttaccatctctcttgtaaattgttttagaggatacaaaatgaaaatctcattaatctaaagttgctgcagatataggaaggacataaggatggaaacaatgaatgtaattttttaaaaaactgatatgctacaactattttaggatggagaaagaattgattgagaattcaaatcctcactcacttaccataaggtagtaataaaattaataatagttactactatatgatcattatattataagcaggtattacacatacagaattttcaacatttaatcctcccaataagcctatgtggcaggttttattatttccattttatagatcagtaaactgaggcgttaaaatgttatgtaatttgccaaagttcaaaaagctggtaagtctggtactaggattcagtaccaagcagtctgttttaagacagatgattcaagagtatgatagatattagaaatacagatatatctgccagaataacaattaaaatgatagaaaaggctcttacttgggacagcaaccaggacagggatggtagagggaaggtcagagactagagactactctttgctttttttgttttctttttttttcttttaaagctattaacactactcaaattttaaactctggatacaaatgactttgataaaagtccttaaaactattttgacattaaattatttggtattccacaaactacagtagctcatacctatgcaaatatttagaagaaggagaagtaccctttttctttgttttcatgatctccaaaatctagtttttagtctataaacatccatccctactccacattttcatgtaaagattatgtagaagttgggcaacagtgtagtcacaggatgtcatataagtgtgaataagctgagattattgcatttgtatttagcatattatacaattaaaatgtattttattaaacctgaagcaagttttctttcatgtctagacatcagtgtgttacagagtttaattcattaagctctgtatttgaatataacaccttgtaaaaatgtttgaaacttatcctcttgtatgttaaatatttaaatatttgtatatggccctattcagcctgtgctttataaatcacaaaagagctgggttttatatgtttgttttttatttctaagctctctgcgaaaaagttacaaattgtctccttaagatattttttctttgtaatttttttatatcatgttgtgatttccataaatatgtgcagttactcttgataatacttgtcttattcatttcaggttgctataacaaagtaccatagactgggtggcttataaacgacagaaatttatttcttacagctctggagctggaagtctgagatcagattaccagcatggttgggttctggtgagagccgtcttggttgcagactgccatcttcttgtatcctcacatggccaaaagaggacaagagaactctctggagtctgtttgataagagcatgaatcccattacatcttcacatggctcctcccaaagaccccacctcctaatatcatcacatgtcatcacatagggggttagaatttcaacatagaaattttgggagaacacaaacattcagtcagttgcaatacttaaggcaaattcatcttgcttataactctggtgcatgtgcattaaaatactattgcattgtaactgagtttgtacctattttctgctttctgattatttcctttgttcatgaaaataaatgactggtattacaaggtcacctaaataaataggtttgtgtacgtctgcgactagagagaaatactacagtgattaa

SEQ ID NO: 105843 - DNA, 675 bp, Homo sapiens
  Payload ID: 750
  Gene Symbol: ARL6
  Gene Name: ADP-ribosylation factor-like 6
  ENST ID: ENST00000476753
  CDS Start-End: 1-164
aagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatggactctgacctttttaagaacataggacttcaggtatgctaatttggccattaattatttaaaaactaaatattccctcaaaagggctccctagaattatcaagttcttagtgaaggtctacatttgattgtacgtagaatgtttaaaagtcagttataagccatctcatcccatcataatttatgatatgtttaatatattttattttttaattgtctttttaaaaaatttagtttatgactttgcagtatgaattgtgcttgtgaaaaagaactttaaatatttataagggaccatgggtaattaatatatattcaatttttactatgtgtcactgtcaataaaatgtaaaatataatgtgcc

SEQ ID NO: 105844 - DNA, 557 bp, Homo sapiens
  Payload ID: 750
  Gene Symbol: ARL6
  Gene Name: ADP-ribosylation factor-like 6
  ENST ID: ENST00000631834
  CDS Start-End: 1-444
atccttccaacaataggattcagcatagagaaattcaaatcatccagtttgtcatttacagtgtttgacatgtcaggtcaaggaagatacagaaatctctgggaacactattataaagaaggccaagctattatttttgtcattgatagtagtgatagattaagaatggttgtggccaaagaagaactcgatactcttctgaatcatccagatattaaacaccgtcgaattccaatcttattctttgcaaataaaatggatcttagagatgcagtgacatctgtaaaagtgtctcagttgctgtgtttagagaacatcaaagataaaccctggcatatttgtgctagtgatgccataaaaggagaaggcttgcaagaaggtgtagactggcttcaagaaaaaacaatacaatcagatccagactgtgaagacatgaaaagataatagttggaaacctcagcaattttcaattcaaggaatctatctaagacaaatagaatacattttgtaaaagatgtttatgcatcaaaaaatataattttctgcttgcatttatg

SEQ ID NO: 105845 - DNA, 2409 bp, Homo sapiens
  Payload ID: 751
  Gene Symbol: ARL6IP1
  Gene Name: ADP-ribosylation factor-like 6 interacting protein 1
  Uniprot ID: Q15041
  ENST ID: ENST00000304414
  CDS Start-End: 213-824
atgcgctgagcttcggttggcccggcttccttgaggcgtaagctcggtctgtccaatgaggagcgagcgtcgcgggggccgtcgggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttca

SEQ ID NO: 105846 - DNA, 1107 bp, Homo sapiens
  Payload ID: 751
  Gene Symbol: ARL6IP1
  Gene Name: ADP-ribosylation factor-like 6 interacting protein 1
  Uniprot ID: Q15041
  ENST ID: ENST00000546206
  CDS Start-End: 278-802
cctggctgcctgtcccccgggagccgagcgaggcctccagacgtccgtgggctcaaacaccgcggcctcgtccctgtcacccgccgcgggcccggcccttctctccctgggcaggcgacgatgcctggccctcgggcttcttgggtgactcctgggtgtcgaacccttacctttcctggggacggtgcgcgacggggcgaggagggcgcgtgattcatcaccgcgagctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttg

SEQ ID NO: 105847 - DNA, 391 bp, Homo sapiens
  Payload ID: 751
  Gene Symbol: ARL6IP1
  Gene Name: ADP-ribosylation factor-like 6 interacting protein 1
  ENST ID: ENST00000562234
  CDS Start-End: 88-391
cctcgggttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatggcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatga

SEQ ID NO: 105848 - DNA, 948 bp, Homo sapiens
  Payload ID: 751
  Gene Symbol: ARL6IP1
  Gene Name: ADP-ribosylation factor-like 6 interacting protein 1
  ENST ID: ENST00000563861
  CDS Start-End: 82-381
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagt

SEQ ID NO: 105849 - DNA, 578 bp, Homo sapiens
  Payload ID: 751
  Gene Symbol: ARL6IP1
  Gene Name: ADP-ribosylation factor-like 6 interacting protein 1
  ENST ID: ENST00000562819
  CDS Start-End: 82-348
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatggtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagt

SEQ ID NO: 105850 - DNA, 1644 bp, Homo sapiens
  Payload ID: 752
  Gene Symbol: ARL6IP4
  Gene Name: ADP-ribosylation factor-like 6 interacting protein 4
  Uniprot ID: Q66PJ3
  ENST ID: ENST00000315580
  CDS Start-End: 146-1411
ctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 105851 - DNA, 546 bp, Homo sapiens
  Payload ID: 752
  Gene Symbol: ARL6IP4
  Gene Name: ADP-ribosylation factor-like 6 interacting protein 4
  ENST ID: ENST00000357866
  CDS Start-End: 1-546
atggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 105852 - DNA, 1339 bp, Homo sapiens
  Payload ID: 752
  Gene Symbol: ARL6IP4
  Gene Name: ADP-ribosylation factor-like 6 interacting protein 4
  Uniprot ID: Q66PJ3
  ENST ID: ENST00000392435
  CDS Start-End: 15-1214
ggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctg

SEQ ID NO: 105853 - DNA, 796 bp, Homo sapiens
  Payload ID: 752
  Gene Symbol: ARL6IP4
  Gene Name: ADP-ribosylation factor-like 6 interacting protein 4
  ENST ID: ENST00000456762
  CDS Start-End: 1-651
gccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtgatgtacccctcctcctgtgtgctttcttccccagcaagccacccgaggggactgcctggccttccagatgcgagctgggttgcttccctgagggcccccgctggccaaggcctgtggacgacgctggcggcccagcctgggcaggt

SEQ ID NO: 105854 - DNA, 796 bp, Homo sapiens
  Payload ID: 752
  Gene Symbol: ARL6IP4
  Gene Name: ADP-ribosylation factor-like 6 interacting protein 4
  ENST ID: ENST00000439686
  CDS Start-End: 77-766
gggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacga

SEQ ID NO: 105855 - DNA, 1318 bp, Homo sapiens
  Payload ID: 752
  Gene Symbol: ARL6IP4
  Gene Name: ADP-ribosylation factor-like 6 interacting protein 4
  Uniprot ID: Q66PJ3
  ENST ID: ENST00000454885
  CDS Start-End: 405-1085
cttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgaggtgggaacggagcagccccgggggcccccttgaggcggcgaggccgcgaagggcgcggggctggagggtaggagagcgcgggaaagcgccccagacgccactcgcggcggacggcggccagttcccaggggtttggagccggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 105856 - DNA, 910 bp, Homo sapiens
  Payload ID: 752
  Gene Symbol: ARL6IP4
  Gene Name: ADP-ribosylation factor-like 6 interacting protein 4
  ENST ID: ENST00000426960
  CDS Start-End: 135-791
gggtccatgcccgcgctcactgccaagatctttctggcccctacggacacgagtttgcgacctctgagtcactgggtgggcgcgtcggaaagaccagggcgcctcagtctggagctcgcagtccccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctgg

SEQ ID NO: 105857 - DNA, 818 bp, Homo sapiens
  Payload ID: 752
  Gene Symbol: ARL6IP4
  Gene Name: ADP-ribosylation factor-like 6 interacting protein 4
  ENST ID: ENST00000412505
  CDS Start-End: 122-634
gagaaggcgcggggcgggctgtccggcccgcagggcggtcgaggtgggaacggagcagccccgggggcccccttgaggcggcgaggccgcgaagggcgcggggctggaggcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccc

SEQ ID NO: 105858 - DNA, 1491 bp, Homo sapiens
  Payload ID: 752
  Gene Symbol: ARL6IP4
  Gene Name: ADP-ribosylation factor-like 6 interacting protein 4
  Uniprot ID: Q66PJ3
  ENST ID: ENST00000453766
  CDS Start-End: 17-1258
gtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagac

SEQ ID NO: 105859 - DNA, 1295 bp, Homo sapiens
  Payload ID: 752
  Gene Symbol: ARL6IP4
  Gene Name: ADP-ribosylation factor-like 6 interacting protein 4
  ENST ID: ENST00000539770
  CDS Start-End: 210-857
ccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggataga

SEQ ID NO: 105860 - DNA, 799 bp, Homo sapiens
  Payload ID: 752
  Gene Symbol: ARL6IP4
  Gene Name: ADP-ribosylation factor-like 6 interacting protein 4
  ENST ID: ENST00000413381
  CDS Start-End: 167-799
gcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtccccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaag

SEQ ID NO: 105861 - DNA, 1119 bp, Homo sapiens
  Payload ID: 752
  Gene Symbol: ARL6IP4
  Gene Name: ADP-ribosylation factor-like 6 interacting protein 4
  ENST ID: ENST00000542099
  CDS Start-End: 198-1119
ggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcacca

SEQ ID NO: 105862 - DNA, 1591 bp, Homo sapiens
  Payload ID: 752
  Gene Symbol: ARL6IP4
  Gene Name: ADP-ribosylation factor-like 6 interacting protein 4
  Uniprot ID: Q66PJ3
  ENST ID: ENST00000543566
  CDS Start-End: 146-1354
ctgtcattgtggaagagttgcaacttgggggcccgagattggatgaagcgcacagccacgctttgggttacacatttgaaactcagggggcttccatattgcagtcttgagtttggtctccctgggaaggtggggcaccagccccatgccacgttgcacgtatcagctggagcagaatcctggcttccttccggatgggcctggggtccatgcccgcgctcactgccaagatctttctggcccctacggacacgagtttgcgacctctgagtcactgggtgggcgcgtcggaaagaccagggcgcctcagtctggagctcgcagtcgtatggagagggcaggaccagccggggaggagggcggcgcgcgcgagggtcgccttcttcccagggcaccgggggcgtgggtgctgcgggcgtgcgccgagagggcagccttggaagtgggcgcagcttcggcagacacaggcgtgaggggctgcggagctcgagggccggcgcccctgcttgcctctgcgggaggtgggcgcgcccgggacggaacctggggcgtcagaacgaaaggcagcggcgccgcgcttcccagccggccagcctcccgcgcagcgccccggccggaagcctcctcgccgccgcttcctctcgagaaggcgcggggcgggctgtccggcccgcagggcggtcgagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctgagggcccccgctggccaaggcctgtggacgacgctggcggcccagcctgggcaggtttcagggtgccagtgggaagcctgatgggtgctggtggcctttcccccgtggattggtctctggcccagcccagtctcttctcaggggcagggggtggaggttggggtcaccggcctgcttggcacccccatctgaaagagcagcacttctcagctattaaaggccccctggatagactttc

SEQ ID NO: 105863 - DNA, 2101 bp, Homo sapiens
  Payload ID: 753
  Gene Symbol: ARL6IP5
  Gene Name: ADP-ribosylation factor-like 6 interacting protein 5
  Uniprot ID: O75915
  ENST ID: ENST00000273258
  CDS Start-End: 105-671
cgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaaggtt

SEQ ID NO: 105864 - DNA, 387 bp, Homo sapiens
  Payload ID: 753
  Gene Symbol: ARL6IP5
  Gene Name: ADP-ribosylation factor-like 6 interacting protein 5
  ENST ID: ENST00000485444
  CDS Start-End: 7-186
gagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtgggatagaaccatgtagctgctgaaggaatgagcccatgatttctcagctgaagtaactcctcaccatgtggcctgatcatttggcctatggagatgttgcaggagggtggaattgacagctgccactttatgctttcagttactcaagatggtttctgagtcccttcaacatgatcctgggaggaatcgtggtggtgctggtgttca

SEQ ID NO: 105865 - DNA, 551 bp, Homo sapiens
  Payload ID: 753
  Gene Symbol: ARL6IP5
  Gene Name: ADP-ribosylation factor-like 6 interacting protein 5
  ENST ID: ENST00000484921
  CDS Start-End: 34-315
gattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggctggagtgcaatggcgtgatctcagctcactgcaacctccaccttctgagttcaagtgattctcctgcctcagcctcccaagtagctgggattacaggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgaga

SEQ ID NO: 105866 - DNA, 1449 bp, Homo sapiens
  Payload ID: 753
  Gene Symbol: ARL6IP5
  Gene Name: ADP-ribosylation factor-like 6 interacting protein 5
  ENST ID: ENST00000478935
  CDS Start-End: 28-294
ggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaaggaggacaataatagctgatcttttgaaatttgaaaaacgtctttagatgaccaagcaaaaagactttaaaaaatggtaatgaaaatggaatgcagctactgcagctaataaaaaattttagatagcaattgttacaaccatatgcctttatagctagacattagaattatgatagcatgagtttatacattctattatttttcctccctttctcatgtttttataaataggtaataaaaaatgttttgcctgccaattgaatgatttcgtagctgaagtagaaacatttaggtttctgtagcattaaattgtgaagacaactggagtggtacttactgaagaaactctctgtatgtcctagaataagaagcaatgatgtgctgcttctgatttttcttgcattttaaattctcagccaacctacagccatgatctttagcacagtgatatcaccatgacttcacagacatggtctagaatctgtacccttacccacatatgaagaataaaattgattaaagg

SEQ ID NO: 105867 - DNA, 2805 bp, Homo sapiens
  Payload ID: 754
  Gene Symbol: ARL6IP6
  Gene Name: ADP-ribosylation factor-like 6 interacting protein 6
  Uniprot ID: Q8N6S5
  ENST ID: ENST00000326446
  CDS Start-End: 712-1392
cggtgctcgaggcggaggggaggaggcggggaaggcgaaaggaggggttcggaggagagggttcgatctccgtacgcaccaggtggagagcgcgcgcctggggaaggaggcgtgtcgagtagcgggagggaagttgtagtacgggtggggagaaccacactaaagggagatgggggtgagcagttaaggaaccgcgagagcgccaggtagagaggtgcccttaatgggggaacctggagaagagtgtgagcgtagtggggaagaagggagaagacaaataggttcgggaatgtgtctccgagggcgcgagcgggcgctaggacccggcgtcgaaaagatgaggctttggggctgtcggggcgcgcgctcccgttggtgacgcgggggtggcggaggtctccggccgggacgaagccccgcagggagtggatactcgacagccttcggcctccgctcgcttctccctgcgcgctttcctgctcccctttccggctacagccctggggtcgagctctggtcgaagcgcattccgcctctcctttggccctgcggcttcctttgcaacccgccgcccacccttgctctccgtggtttacccctgggctctgaggcctggtggtagcggccactgccgcggattggctgttgcggacccggggcggggcaggtgggagaggctcgttctccgcgggtttcgttgtgtttcgcgccatgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgattgttttgtaataacaagaaggagcatcactgtctactcagaagactgagaaacctgctgttcattatgtagttcagatatttatcacaatcatcctcattatggaagaccttttaaagcattgttttagaatgtctgagtattaagatacagattaattgggaatatctgagtattaagtactttcttcagagtataagatgtttacctcatctttttacttttgtgtgtgtagttctttcaagttgtaggaaacattttaatggaatttaaactcaaaaacttgaatacaggacaatgcttgccttttcatgtatgtactacattttttgctaagaaatactgatatttctgtttagttgagctagaaatacttcttatttatacatttaggaaagcaaataatgcctactactccgacttttatagaagctacttttaaatcagaatatttaatttttgatattcatataattaatagaagttgcatttatattttttatggggcatagttccttatgtgtttttttaatgtattttcatactacatactgaatttgtatgtttttaaaattgttacatctagacaactgtaaacattatttttttagctagtgcaaacctagtacctgccatttttactaatttttgtctttaaaaaaagcaaaaaagcacattgacctaagttgaaaattaagtaagtttatttttaacaaaaaatgcctgaaaaaagctaaattatttaagtcattaagatattgagaaaaaatttgaaatttttactatttctgtttccacaattccaaatatttatcttggtgtatatattgttactttaacagaacttgcattattttgtttttaataaatataaacatgaaatttttgtatgtgagaatgattgaactagtttgttcttaatctcaaaaatttagttaccaaagtagaaaaggtattttgatactagatattaaaaactacatatagttaatataattttataatttttgtaattaaatgtgctcctgtaattgtgatattttgttttctaagtaattaagccttaatttttcccctatgttactaaagacttttaatgtttagaaagttacctcagttttagaaagatggactacttacaaagctgttttccctggccataggaaaacttacaataagaaaccattaagtagtcaaactgcttattcaggctaagtgggaaatgaatttgtgcagtgtgttcccttaattatctactgaatgttgttaccgactaaacaaggtttctaaaagtctcgcatttcttttactattcaaaactctttggttggaaatgactaatactgctccaatttaaattatctgaaatgtg

SEQ ID NO: 105868 - DNA, 465 bp, Homo sapiens
  Payload ID: 754
  Gene Symbol: ARL6IP6
  Gene Name: ADP-ribosylation factor-like 6 interacting protein 6
  ENST ID: ENST00000425034
  CDS Start-End: 1-116
tctgctcgctgctcttcgccattcttctcgccttcctcctcgccatcgcctacttgatcgttaaagcgtttagtgggctacagatggcatggcatctaaaaccttacaatgcttgattttcatacagaagacactttggccagttgatgtgggttttacctcttcataaaatgagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactgg

SEQ ID NO: 105869 - DNA, 479 bp, Homo sapiens
  Payload ID: 754
  Gene Symbol: ARL6IP6
  Gene Name: ADP-ribosylation factor-like 6 interacting protein 6
  ENST ID: ENST00000455875
  CDS Start-End: 1-201
gcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggaattatctgtattagcaggaaattttcccttatgctgtaagttgcaaaggattctggactctacttataatatccctaactgctggattctcctgttgcagcttttcttggacagtgacttactttgattcttttgaaccaggaatgtttcctcctactcctctttcacctgccaggttcaagaaactgactggacattctttccacatgggctatagcatggcgattttgaatggcatcgtagctgctcttactgtagcatggtgcctcatgtaaacccacactggagcgatattgttggcaaaacttaatcatgat

SEQ ID NO: 105870 - DNA, 1793 bp, Homo sapiens
  Payload ID: 755
  Gene Symbol: ARL8A
  Gene Name: ADP-ribosylation factor-like 8A
  Uniprot ID: Q96BM9
  ENST ID: ENST00000272217
  CDS Start-End: 170-730
cggcgagccgattccggggcagcgagtcgtcggcagccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggg

SEQ ID NO: 105871 - DNA, 1727 bp, Homo sapiens
  Payload ID: 755
  Gene Symbol: ARL8A
  Gene Name: ADP-ribosylation factor-like 8A
  ENST ID: ENST00000614750
  CDS Start-End: 172-615
atcggcgagccgattccggggcagcgagtcgtcggcagccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggg

SEQ ID NO: 105872 - DNA, 3005 bp, Homo sapiens
  Payload ID: 756
  Gene Symbol: ARL8B
  Gene Name: ADP-ribosylation factor-like 8B
  Uniprot ID: Q9NVJ2
  ENST ID: ENST00000256496
  CDS Start-End: 247-807
ggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatcca

SEQ ID NO: 105873 - DNA, 1641 bp, Homo sapiens
  Payload ID: 756
  Gene Symbol: ARL8B
  Gene Name: ADP-ribosylation factor-like 8B
  ENST ID: ENST00000455168
  CDS Start-End: 3-314
atatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactctt

SEQ ID NO: 105874 - DNA, 1684 bp, Homo sapiens
  Payload ID: 756
  Gene Symbol: ARL8B
  Gene Name: ADP-ribosylation factor-like 8B
  Uniprot ID: Q9NVJ2
  ENST ID: ENST00000419534
  CDS Start-End: 171-662
gatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccaatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctaga

SEQ ID NO: 105875 - DNA, 709 bp, Homo sapiens
  Payload ID: 756
  Gene Symbol: ARL8B
  Gene Name: ADP-ribosylation factor-like 8B
  ENST ID: ENST00000429403
  CDS Start-End: 46-354
gccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgaccaagaatcttgaaagccaaatgttctcattaagaagctgttagagtgcaataatgcattctaaatgcctgtcttagaagatatttcacaagttaatggattttttaagtttttcaaagatatatcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaa

SEQ ID NO: 105876 - DNA, 2981 bp, Homo sapiens
  Payload ID: 756
  Gene Symbol: ARL8B
  Gene Name: ADP-ribosylation factor-like 8B
  Uniprot ID: Q9NVJ2
  ENST ID: ENST00000611208
  CDS Start-End: 222-782
gggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccac

SEQ ID NO: 105877 - DNA, 1258 bp, Homo sapiens
  Payload ID: 757
  Gene Symbol: ARL9
  Gene Name: ADP-ribosylation factor-like 9
  Uniprot ID: Q6T311
  ENST ID: ENST00000360096
  CDS Start-End: 315-686
agctgagggaaggctgagaatcctcccggaacctctggattctgacgccccaggggttcttcacacaggctggccggtctcgggattgaagccggagacgtcagacgctaaggttgcttagactgcggcccacgtggaaggctcttagccaccctgcctggcccgaggagaaaaacaagcaaatcctagtgctgggcctggatggagcaggaaaaaccagtgtcctgcactctctagcttcaaacagagtccagcacagtgtggcacccacccaaggtttccatgcagtttgcatcaacactgaagacagccagatggagttcctggagattggtggcagtaaaccttttcggtcctactgggaaatgtacctatccaagggattgctgctgatctttgtggtggattcagcagatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttccacctcaaataaaaattaagccatttcctattttctcagtgcatgggatgtatatagttagccctccatatccatgggttccacatctggggattcaagaactgtggatccaaaacattcaaaaagtaaacccactgaagaataataacacaacaataaaaataatacacattttaaaatacaatataacaactatttacatagcattttcattgtattaggtattataagtaatctaaagatgatttaaaatacacgagtagaagtgtgtaggttatatgtaaatatgccattttccatcaggagcttgagcatccacatttgcctgtgaggatcttggaatcagtctccctgagaataccaacggacaactgtacaaagataatgctaacataataacagcatctctatttggattttgaatgttaaaaatatttgtaaaacagtgtattgggggtattgggatttttaatcaacaaaggtaaaatgaacatt

SEQ ID NO: 105878 - DNA, 1877 bp, Homo sapiens
  Payload ID: 758
  Gene Symbol: ADPRHL1
  Gene Name: ADP-ribosylhydrolase like 1
  Uniprot ID: Q8NDY3
  ENST ID: ENST00000356501
  CDS Start-End: 177-995
ggcacgagagcagactctgaaccaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgagggccaatgcacctccccccaccccccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgatgttta

SEQ ID NO: 105879 - DNA, 1341 bp, Homo sapiens
  Payload ID: 758
  Gene Symbol: ADPRHL1
  Gene Name: ADP-ribosylhydrolase like 1
  Uniprot ID: Q8NDY3
  ENST ID: ENST00000375418
  CDS Start-End: 88-1152
tgaccactataaaagtcaggcgggctgaggaggagacaaaggccaggacgctccgcagctgttggggaagaggagctgcctcctgggatggagaaatttaaggctgcgatgttgctggggagcgtcggcgatgctcttggctacagaaatgtctgcaaggagaacagcactgtaggcatgaagatccaggaggagctgcaacgttccgggggcctggaccacctcgtactctcgccaggagaatggcccgtgagtgacaacaccatcatgcacatcgcaaccgccgaggccctcaccacagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcg

SEQ ID NO: 105880 - DNA, 839 bp, Homo sapiens
  Payload ID: 758
  Gene Symbol: ADPRHL1
  Gene Name: ADP-ribosylhydrolase like 1
  ENST ID: ENST00000413169
  CDS Start-End: 312-839
ggtccctccttcccggtgagcctctctgactggggctgcctccttccgggtgagcctctctgactggggctgcctccttccgggtgagcctctctgactggggctgcctccttccgggtgagcctctctgaacagggcacgagagcagactctgaaccaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaag

SEQ ID NO: 105881 - DNA, 9759 bp, Homo sapiens
  Payload ID: 758
  Gene Symbol: ADPRHL1
  Gene Name: ADP-ribosylhydrolase like 1
  ENST ID: ENST00000612156
  CDS Start-End: 88-5991
tgaccactataaaagtcaggcgggctgaggaggagacaaaggccaggacgctccgcagctgttggggaagaggagctgcctcctgggatggagaaatttaaggctgcgatgttgctggggagcgtcggcgatgctcttggctacagaaatgtctgcaaggagaacagcactgtaggcatgaagatccaggaggagctgcaacgttccgggggcctggaccacctcgtactctcgccaggagaatggcccgtgagtgacaacaccatcatgcacatcgcaaccgccgaggccctcaccacagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaaccggaagagcagcaagacctgcagtgacgtcatgtctgtggacgcccaaaccctgaagaagaagatgggcaagctggcctgtgacccggccgcccactccatcctcagcagcctgctgctctacgtcacgggccgcgcagaccggcccccggggacagaggccggggggagcaggcccagccaccagccccagacccaggaggccacccagcggcccacgcgcttccagctcctgcaggccaagttcctgggcactggccgggagcgctacctcaagaggaccagggaggtgggccggctgatctccaaggacaagcaggggccgggtgggggcctcgtgggtgccaccatcaacaagctcctggagaagaccaaggagccggccccaaagccctgcctcagcgagaagccccgctggggccacccggccgggaagagcaccgtgaaaaacatcctgaagatattcttggccgccgaggagaaggaggcgaaggagaaagaagcacgcgagaagccccctgtggagcggcccaaagccgccaggggcctcttgccgaagatcatgggcaagagctcggtgctgtccaagctgcgggagaagttcgagcagaacagctgcctgtgctccgaggccagtgcgctgaggctgcacacgcaggagcggaagaagaggaacctgcagaggaagaggatgcaccggccggaggtgcgcgtgctgcacacggccaccatggccagcacctgcgtcaagatgccccctgcccgctttctggcctgcacggctgagcccctgccggccctcagcatcgccaccgtcgtctgtggccccaggagctggctgtcccactgcaccaaaatcagccactcggaggcaaggcgtccacccagaggagaagccagcgtgccccctagtgccagggagacggggcccagtgggaacaaagcagtgggaaaggggcccctggaggaggagccccaaagacagccaaggccctcgaagcccgtgacaccccaggtgatggctcagagggacggccacgctgtcccctcgctggccttctcttgtgctccctgcacaggtggagtccttcctggccttgtgcctgcatcatccccactgggaccggccagcccttggggcaccggatcagccggaggtgatgggactgcagaccccaccgcagagagcaccgcaggaggcgtccaggaggtgaggggagccaggctcacgtggcctcctgggcccccaggcgagtgtgcaggggagggccctgaaatcaccatgactgtttgcagttcagaggatgaaagggaaggagcaggcttcccagacccagggagagaccccctctttgccacccagaagtatttcccagaacagaaggtgccggagcacatcccacccctgaacgctccatcggtccaggctgctcggagaacacagcctgccacggagcctccacggataactgtccaaattccagttgtccatgaaatgccagcccctcccaccaggctgcaaaatatgtcaagtggtgaaaacaaaccttgtatttgtggaggagagaatgtggttgaaaatgcccacacagaatttcccaccgtgactgagaacagaaggggtcaccgagccccagtggaactgagcaagctttcagggatgcaggcgggactcagcgcctcttcgccgcaggggccacgggcagctccgcgtctggcagcagcaagaggggctgtgggcgccgaccacagtgtcccagagacacttctgacacagagactccagacagatcctgctggcgggaaggaaaacaaaggcagctttgagaattcacacggtcccaggaatcctgacgatatttcaggagagaggacctctgagctcagagatgtgaagcatccgttgccggaatctaatgaaatatcaatgcagaagaagggctccgcaacaaatgatcctgcagcctcacaaaaccttctgaggggaaacaccagccatgcctccagcagccagcaagtgccgtccccgactgggagaaacccaacaggagcccccacgtcactggcggcatcatccaaggggcgtacggggcctgagggtgtcaccccgatgggcatgacagtgcccggtgcgctggaggaatgcagaaggccgctgctaatagagtcttctcagcccctgaaggctgccgaggaaatcaccagccatgatgttcgcgagaacccactgtcctcattaaatgaaccacccaaaccaggtatgaaagcctgtggggcgatggcagctgcagggagcgttgcgagccgcgccacgcctgcaccagcgccaggcagcacccagagccctggagaccgcacagcgggagagccagagacgctgggccagtggggaagcagagccttgtccgaaagccaccccagaggagaggctctccctcgagaccctcacagccacggcctcctggcccctgggggatccttggagcccaagagtggagcagcagggaggagcctcctgagaggcgtggccctcgtccagcacccagaggacattgcgaccctcgcccgccacccggaggatgctgcggccctcgcccggcacccagaggcggcccgattatacatttcaaacacatcagcagccagcagacatacagcagctgtaggaggcagaaaggatgtggctgtggaaggaaaccttttgggtttcagcacagagtctggaattcctgcttctgatcatcctaggccacaggcaaggagcgtggcagagtcccccagctatggccctggcctcccgccgtcgcctcctgagaacccacaggcaaagggcagggagggcgtcaggtttccccgtggggcggagcctgaccatctgcttcccgcagtgcctcccgcggaggtggacatggggtgggtaggtggcacccaccagcggggccctccccatctacaggcacacctgccccctactgctggtgacacacaggcaaagctccgggccagtgtccccgagcctaggacgcaggcaggtgaatcccaggagcgtcccctgacacaggcggacctggggaggcaacagagtcaccaggcacaggaggagaccccccagcccggggatgcggggaagagggtggcgccgtcgggctcgaaggttgtgctgaacccagcaaaagagcctcagacatggtgggcacaggatctggccggggacaaagggatggccattggggttgggggcgcctgccagcgcagtgaccaaggtcagcagcatctgcagggaccctgggaggagcgggggcggagcacggcgtggggagagggcaccagggctgccaggaacccagctgtgcctccaggggagcccgaggggccgggaagcccggcagcccaaggacaggcccagaaacaggttcaggaatgggaccggggacaggttcagggacacgctcaagaacaggcccagtggcagacccagatagaggcccaggggcaggcacaggaacaggctcagggtgggacccagggacacagtcagggacaggcccagaaacagtttcagaattgggcccagggacaggctcagggacacgctcaagaacaggcccagtggcagacccagatagaggcccaggggcaggcacaggaaccagctcagggtggggcccagggacaggttcagggacaggcccagaaatgggctcaggggcagattcagggacaggcccagaaacaggttcaaggagaggttcagaaatgggcccaggaagaggctcagggacaggcccagtggcagacccagataaaggcccagaaatgggctcaggaacagacccagaaaggggctcaggaacgggttcagggtcaggcccagaaaggggctcaggaacgggcccaggaacaggctcaggagcagacccagatagaggctcagggtcaggcccagaagggggctcaggaacgggctcgggaacaggcccagaaaggggctcaggaacgggctcgggaacaggcccagaaaggggctcaggaacgggctcgggaacaggcccagaaaggggctcaggagcgggctcgggaacaggcccagaaaggggctcaggaacgggctcgggaacaggcccagaaaggggctcaggaacgggctcgggaacaggcccagaaaggggctcaggaacgggctcaggaacagggtcgggagcagacccacatagaggctcagggtcaggcccagaaaggggctcaggaatgggctcgggatcgggctcgggatcagggctgggagcagacccagatagagactcagaggcagacccagaaaggggctcaggaacgggcttgggaacagggtcgggaacaggccttgacaagtgggatggcgcctcgggcctgggagcagcccattagtggcatagctgagggagtggatgctgctggcaggagtggggggtccagaagcccagcccccagggatggtggacagtcagggggcagtggcctgggggagcccagcgccgggtacccacccccaggaagccgccccctcaggggcaagagcattgccacctctcccctggggctgggaaagagcccaactgagcccaagcctgaggctgggggctgcgggactccccaggccccggcccaggaggggtccccagaccaccctggggctgagagggccctgcaggacaggatggaggcatcggagcccgagcgtcgcgggaggtccaggcacctggccaagtacaaagcccagagcttccgtgaccagagggccttcgatttgtccttcagaccaatgagcgtcagggccagcgacacgtctgagctcccaaagtgaggccccgagtacacaccgtggctcgcccagcactgtgacatccgcccattgagggacttcaggcattttcctgcctccaaatgcgtcttggagcatcccctacagagacgcctgtttccataattttctttcccttcttcacaagctgaccttgggaggattgagctacatgtgggtcgggttcctgtcaccccacagagccacgaggccatgggggtgggaggtgcgggcctgtggcctcaccaggccctcgggattctttgtgtcttcactcgggggcgccggctcacccctctctcacacagcctgcagcgtggagctcacacctcccgcagtggcacggtgtgtgcgtccccttcgatctgcaggatgctggcactttgggacacctccccagctctcacagggccacctcccactgctccctgcccacaccccaccatgccctgctctgacgtggccgcatggcacccaccatccatgggcccaaagtgatgcacaccgccccacccccatgactcgaaagaaagggcagagcttcctccagcctcagacgcccaggtgggtgccgggtgctgtgtggctgctgggccatgtggtggtcaccagagggtgtggggacgctgggatcccaggccgaaaccagctcatccggaggaagaggcctcaggaaatgcccacgttaagttctgagaaagggacagtgcagagccgtgggaagccaggatcccagggaggcttcgtctggaaactgggtgctgggagaacgaacgggagcctgcccgcccttccctgcagtccctgtgggtggtgccactggtgccggtgacctgagagcctcgctgtctgtcctccgtcctcccgaacagcatagaagtgtttcctgccctggcccgagacggcccacgactccggccctgttcaggtactgaggtaatgcatgttcaggctggaatatttgaatgctgtctagaggcacaagaaggaaatcaaagccacctgtggtcacattgcctcgagatggtttttgttgctactctggactattttttaggctcttcctccatgcacctattttaaagcacattcttccccatgatggagccatgcacctccgtgtcgcgatccatcgtcccaggccactcggtggcctctgaaacccggacccgtgaggccacacggctgcctgagtggccccggagcagctggattttcagcgtgaaccgatgcagcctgtcgccctacagccccgcacccttgtttttggtggtgccctccctgtggaaagttaattcctgctttttgaaggtgtcttggcatcttctgcctttgctactgagcggtttcctgaaacagccctaagcgttcgcaaaggcgctttggtgcctgctgcgagcacctgttttctgactcggatgttcctttagaggaaggtgttttccagtgtcggccctgagagggcgttcagcaggcgcgtcctacccacgcggggctgaggtctctccttccagggaaggtccatcccggcagacgccagtggctttggctctgcagcgccaaggaggcggcgtggcgtcatgctccggggagcgcacaggtttccttccagtcgaacaattaacttcagatccagcaggtttgacccaccctcacctgctgggacatgcgagtgctggtgtctggaaggagggccgggctgtgctgagctctggggggccggtccccacagctcccccgacagggcccccggggcctcctctataaatcaggggtccgtgctcccagcccgcttcgaggggtttctgcttggcgtgtgggttctaagtgcgagctgctgtgtgtggaggctcctgagcaccgggtgcccctcgcgcgtgtgggtcccggggcagcccagctgcacacaggatggtccgggggtgcgggtgggggcagagctgagcatggcgtgtacttggccacagaagtcttgctgtggtgccgctggacccctgctaggaggacagggtcccctctctcacgaagcacacggacctccagagtccctgcccctgcagtcctgggagcctgcagttggggctggagttggcctctcggagccacccaaacggagaggcccatgagaggggagctcaggggtccagcagaggctgacagagtggcctctttgtcctgttggcggcccctgctcatgcctggggcgtcctccctggagctgggggagctcagggacccccaggtctgtgtggctgcccctgccactccaggcacagcggcacggccctcactctttacctatttggaattggaggcaatgagtggcaagaacatgatgacagacacgggaggtaaaaatatgttcactggctgttccctttataaataagaagtggtgggacttgcgctgctatttttaaatagaccagagagtacactggagaaggcattgagtggttttattttaagtggtggaaaaaatgatgagaatctcctccagatgacagctccggaagtgtcgtgcctgaacccctctcacagtctggcgggcgcagagtctgtgagcggccaggaggccacctgctcgactggcccgtcctctccatgtgccagatgcagcccagcatgacactgccctcagctcaaaaacagcacagctactctgtgtgcaggaaaaaactgccagtgacttcaccaggatttgagaacggtccgtacgttcacactaagctgagacagcgcaggttagaagatagcgcggggaagtattcacacttcagatacgaccatcacggccacatggctaaggcccacaccctcccggggtgaaataactacagcagaagaatggggcgctaaccacctccacgggcattttaaataaaacccaaagttgttttgtttttttaaaaaaaaaaaaaaagaaagaaagaaagtggccgggcacggtggctcatgcctgtaatcccagcactttgggaggccgaggcagacagatcacgaggtcaggagatcaagaccatcctggctaacacagtgaaaccctgtctctactaaaaatacaaaaattagccgggcgtggtggtgggtgcctgtagtcccagctactcgggagcctgagacaggagaatggcgtgaacccgggaggtggagcttgcagtgagccgagattgcgccactgcactccagcctgggtgacagagcgagactccgtcaaaaaaaaaaaaaaaaagaagaaaagaaaagaaaagaaaacaggatatttattttagcttcttagttaacatcattaattttgtgtagttgagcgactcgttgactgcctcctccctgcagttttttacggtgcctccggctgtcgacaggcccactgtgagccgcaggtctgtgggtgcaagtgacaacagccgggcgggaggcggtgcactcaggcggcaggaaggtcccgagacggcgacgagaatgtggtcatgttcaggacactcgctcagggagggtcgttgtctgggattttacacgctcagcaccacctccttattctgttctcagggtatctctgctgttggagttacggtctttcggttgtgtattaggctacagctatttattaaatttgttcttgttcatattcttctttgtatataaacaaccctaaaatgggttagtcagaaaaaattactaaatgtcatttgttgtattctctctgtatttttactaacatcattcagctggaaataatttcaaaaagaaataaaatacctttcccattac

SEQ ID NO: 105882 - DNA, 1668 bp, Homo sapiens
  Payload ID: 759
  Gene Symbol: ADPRHL2
  Gene Name: ADP-ribosylhydrolase like 2
  Uniprot ID: Q9NX46
  ENST ID: ENST00000373178
  CDS Start-End: 31-1122
caccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctca

SEQ ID NO: 105883 - DNA, 1312 bp, Homo sapiens
  Payload ID: 760
  Gene Symbol: ART1
  Gene Name: ADP-ribosyltransferase 1
  Uniprot ID: P52961
  ENST ID: ENST00000250693
  CDS Start-End: 102-1085
ggccatggtggagatcagcagcagcttccccacccaggacaaggcctagatgaggaaactgagacccaaaaagagacagcaactggcccagggtcaccagcatgcagatgcctgctatgatgtctctgcttcttgtgtctgtgggcctcatggaagcacttcaggcccagagccaccccatcacacgacgagacctcttctctcaagagattcagctggacatggccctggcctcctttgatgaccagtacgctggctgtgctgctgccatgacagctgctctcccggatctcaaccacacggagttccaggccaaccaggtgtatgcagacagctggacactggcaagcagccaatggcaggagcgtcaggccaggtggccagagtggagtctcagccccacccgtccatccccgccacccctgggcttccgcgatgagcatggggtggccctcctggcctacacagccaacagccccctgcacaaggagttcaatgcagccgtgcgtgaggcgggccgctcccgggcccactacctccaccacttctccttcaagacactccatttcctgctgactgaggccctgcagctcctgggcagcggccagcgtccaccccggtgccaccaggtgttccgaggtgtgcacggcctgcgcttccggccagcagggccccgggccaccgtgaggctggggggctttgcttctgcctccctgaagcatgttgcagcccagcagtttggtgaggacaccttcttcggcatctggacctgccttggggcccctatcaagggctactccttcttccctggagaggaagaggtgctgatccccccctttgagaccttccaagtgatcaatgccagcagactggcccagggccccgcccgcatctacctccgagccctgggcaagcacagcacctacaactgcgagtacatcaaagacaagaagtgcaagtctgggccttgccatctggataattcagccatgggtcagagccccctctctgcagtctggtctttgctgctgctgctctggttcctcgtggtgagggcctttccagatggtccaggcctcctttgatgcatgagacacgggacagcctcgcctgctgcctctgcccatcctgaggatgttggccatgtgtgctttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggc

SEQ ID NO: 105884 - DNA, 1528 bp, Homo sapiens
  Payload ID: 761
  Gene Symbol: ART3
  Gene Name: ADP-ribosyltransferase 3
  Uniprot ID: Q13508
  ENST ID: ENST00000349321
  CDS Start-End: 120-1256
ctcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatattt

SEQ ID NO: 105885 - DNA, 1517 bp, Homo sapiens
  Payload ID: 761
  Gene Symbol: ART3
  Gene Name: ADP-ribosyltransferase 3
  Uniprot ID: Q13508
  ENST ID: ENST00000341029
  CDS Start-End: 131-1234
agtgaggaggttatacccggaggtctcgacgctcgctcgtgctgctcgtgttgccgctgggtacgtttgctgccagtgctgatccagccggaggcgaagagaagcactttgggggcaaaagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatatttcagaattgcca

SEQ ID NO: 105886 - DNA, 1561 bp, Homo sapiens
  Payload ID: 761
  Gene Symbol: ART3
  Gene Name: ADP-ribosyltransferase 3
  Uniprot ID: Q13508
  ENST ID: ENST00000355810
  CDS Start-End: 120-1289
ctcactgtcaacaacatcccatcctgaagacttgcttaccacaactgagagtggggagtcagtttgaggcctagcatcacttaaacttcctccaaaggcacaaaagccagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctgaagataaaagtcaaggaaatatcaacaatcctactccaggtccagttcctgttccaggtcccaaaagccatccttctgcatcctcgggcaaactgctgcttccacagtttgggatggtcatcattttaatcagtgtttctgctataaatctctttgttgctctgtagtttgatgcattgtttatctttcttattctttacttgaaataactatagggatccacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatcccgaaaactgtatacttctgattaaattcaataaaagattttgattagatattt

SEQ ID NO: 105887 - DNA, 502 bp, Homo sapiens
  Payload ID: 761
  Gene Symbol: ART3
  Gene Name: ADP-ribosyltransferase 3
  ENST ID: ENST00000513353
  CDS Start-End: 181-502
ttccagaaccttcttcagtgaggaggttatacccggaggtctcgacgctcgctcgtgctgctcgtgttgccgctgggtacgtttgctgccagtgctgatccagccggaggcgaagagaagcactttgggggcaaaaggccaaaaagaaaaaagaaaaccaatatttaagagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagc

SEQ ID NO: 105888 - DNA, 545 bp, Homo sapiens
  Payload ID: 761
  Gene Symbol: ART3
  Gene Name: ADP-ribosyltransferase 3
  ENST ID: ENST00000504914
  CDS Start-End: 157-545
aaatgctaatgtaaccccaaagaactttacaaagcggaattcttagttttcacaagtgtggcccagcctccctcttgaatctttttggttgtggaatcgaggtgttctgtttaattatccagtgtgactgactctgtggcagggacgaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatat

SEQ ID NO: 105889 - DNA, 352 bp, Homo sapiens
  Payload ID: 761
  Gene Symbol: ART3
  Gene Name: ADP-ribosyltransferase 3
  ENST ID: ENST00000511188
  CDS Start-End: 1-352
aagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctggaatgaaaattccagaaccttttccactacctggaataaaaatgatacaactgaatgaaaaacctgaagataaaagtcaaggaaatatcaacaatcctactccaggtccagttcctgttccaggtc

SEQ ID NO: 105890 - DNA, 801 bp, Homo sapiens
  Payload ID: 761
  Gene Symbol: ART3
  Gene Name: ADP-ribosyltransferase 3
  ENST ID: ENST00000513122
  CDS Start-End: 197-801
gttgccgctgggtacgtttgctgccagtgctgatccagccggaggcgaagagaagcactttgggggcaaaagaatcttctgatggcatgctaacaattgtagatggcaactgtgttggaaactaggggatcccatctgagttggtcaaagtctgccaaaaagaaaaaagaaaaccaatatttaagagaagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatc

SEQ ID NO: 105891 - DNA, 560 bp, Homo sapiens
  Payload ID: 761
  Gene Symbol: ART3
  Gene Name: ADP-ribosyltransferase 3
  ENST ID: ENST00000510423
  CDS Start-End: 37-560
ttcttgttcccgccttcagaaagttataagagaaaaatgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggct

SEQ ID NO: 105892 - DNA, 5129 bp, Homo sapiens
  Payload ID: 762
  Gene Symbol: ART4
  Gene Name: ADP-ribosyltransferase 4 (Dombrock blood group)
  Uniprot ID: Q93070
  ENST ID: ENST00000228936
  CDS Start-End: 383-1327
gctttttcctgtttggctgggaaagggaaggctgaactgctgagtctgacacttaacaggacttcggcattcccctgaatacagactagatcagagattttatttttttaattgaaaagtaacttgggttctctttagaaacccttatttggtgtgcgcatctggctatttcacagagatttcagttttgcaaagaagtcggagttgatttcttccctcagacaagctattggttgttggtgggcaacagaagttgctcagcatagacaggggaaaaaacggttacggatgagactgaaagaaaacctcaaaggagaactctgagaattcatctcaggatgaagctgcaagggcaaaggagaagtacttgtgacacaagcaaatgggtccattgatcaacagatgcaagaagattcttctcccaactactgtacctcctgcaacgatgagaatctggctccttggaggcctgctgccattcctgctgctcctctctggcctgcagagacccacagagggttctgaggttgcaattaaaatcgacttcgacttcgcaccaggttcttttgatgatcagtaccaaggctgtagcaaacaggttatggagaaactaactcaaggggattatttcacaaaagacatagaagcccagaagaattattttaggatgtggcaaaaagcccacttagcctggcttaaccaaggaaaagttctaccccagaacatgactaccacacacgctgtggctattttgttttatacattgaacagcaatgttcattctgactttactagagccatggcctctgttgccaggactccacagcagtatgaacgttcattccacttcaaatatttacactactacctcacctcagcaatccagctgctgaggaaagacagcatcatggagaatggcactctgtgctatgaggtgcattataggacgaaggatgtccactttaatgcctacacaggggccaccattcgatttggccaattcctctccacatccctcctgaaagaagaggcacaggagtttgggaaccagacactatttaccatattcacctgcctgggtgcacctgtacagtacttctccctcaagaaggaagtcttgatccctccctatgagctgtttaaagttataaatatgagctaccacccaagaggagactggttgcagttgaggtcaactgggaacctgagcacatataactgtcagctgctaaaagcttccagcaagaaatgcatccctgatcctatagctattgcatctctctcctttttgaccagtgtcatcatcttttccaaaagcagagtataaagaaatcttgtggctccttttatttaaaaaaaatatttaaataaaatcttttttattggccttttggctagaaatggacatttattttccaggaaggatgatcccatcatacttctgctgaaaccagtgcatggcctcctctttgctaattctcttatgcctttccttgtacccctttgccttatttcaatctgggcaccctaagtactcttggggaaatcactctgcccagctagcaactgatgcagagctggctcagcccactgactgtgattggcctgtaactcaggccttagccaatcagtatatttcttcttcatggacacaaagattcatgctggaatagaaaatgatccaatcagagcctgtgagatacaatcagggtacttttgtggaattgcaattggaaatagaatgggagcttcttttctgaatggatattaatgaaagcagggtaggagcttatagctgccagcaaagatcccgccaccaggagaggagaccccatctccttgagaaaggatctaacacaacaaaggaagagctgataagtgaaaagaaactgagacctgatgagaatgtataagcctctggatccaactttgcctaaagctgaatactacaagatttttcattacataaatcaataatttatgtttttgcttgcataatttgaattagattttctatgtcaagcatcaagcagttgaagttccaacgaatacaagcactcttccttattttttttaatttagttattctaaataggaacaaatcaaagaagattaaattagaaagcaaaggacaaattcttcaccaaacagaaaagctttgaaccccagagattaaccaaggtgtgaattttcttcagagattttttatgagcattcaagattaagctagtatggcctcagatgagaagacacatggaaacttgagaaataaaagggaaagttaatgaaagatgttagtgaaatttcattcaccagcagtaatgggtgttcatgcatgttcctaagacattacaaaagttaaaatttaaactcatatgttaattcatagagaacttgatggcaaatttaagtcttcatagcaaatttaaatattaggaaaacatgagggtatgtgtgaaggttaacagagagtatgagagaaaaaaacactgattacaaacaaatatcagcaatatagcgaggtctcattacatgtaaactagtacatgcaaagaagtataaattgttgaattgtatagctggaaatgtcctctaacgcttccctcaggtagtaatttaggtagcgacataagggattatttaacccgatcacgatcactgaagaccctggtatcaggctaaatggagtaaagatgagggctagctctataattttggattttgaaagtccatgctccttatcccttttaagatttggataagaaacagcaaaactgaaaatcggtccatctatttactctccataggacttcctgaatggcctgtgtcatgatcaaagaaatggaatggggaataagctacataaaattacctggcagggagttcaggcatctctgtactatcattctttaaattgggatttgaaactaacagggccaaatcacctctgtcacctagttgcagtagcctctacagtcaataaaggaaagaatttctgccaggcatggtggctcacccctgtaatcccagcactttgggaggccgaggaggacggatcacgaggtcaggagttcaagaccagcctggccagcatggtgaaaccccgtctctactacaaatacaaaaattagccaggcatggtggcacgcacctgtaatcccagctacttgggaggctgaggcaggaaaattgcctaaacccaggaggcggaggtagtgcagtgagccaagttcacaccactgcactccagcctgggcaacagagtgagactcgatctcaaaaaaagaaaaaaagaaagaatttctacaaacagacaatttatgtgacttgcataggatagggtctttggcagtttggtggctacctagtagagagtcctggggacatggctctgggagcaagcttttccagtgagcatcgatgagtcagtaatgacatgctatgttggtaaaagccacccaacatcttaagtacatttttcctgtgccatataaatgcatgtattgagccatactgtgtacaaagcactttggggattaaaagttaagaacactaggccagatctctcatgagtttacaatctcttaggagaaattaagaacataaagcaagccacaagtgaaatgccaaaaaaaaaaaaggcaaaaatcaagttttctgttcataacaattcaaaagaaagatttcttccaactgaggcaagaagagacacccggaaggctttaagtaagaggctgcatttgaaccagccgttagggctctaggctgggagaaggggtgagcagaaggagaaaaaaacaagaaagagtatgtgccaagtgcgtagtgcccaaaacaaggccaaatattaaatgcttggagctgagagaaaaatgtgattcctctggcctatggttagataaagctttctatcagagatgatgttttacttagaggaaagcagaaaatagaagcgaatacggaatgatcgatgtatgtacagcataaggtcagggagcagataggtctggcagagagtgaggggtaatgtgggctggagaggaaattggaagccactcagtgaagctaaaaagtcagccaaaagcatttgatttccatgagaagtcataattttctgagtaagacaattctcctaaagcgttgactctctaggcacaagcagcaatagcatcctttaagaactcattagaaatgtgaattttagggcctgatcccagactacagactacagaaattgaacagtctgttttaataagtcctctagatgattctgctatacaccaacatttgagaacactgtgacttacacaattatgatccttaagggaatagccaagtttctaaaaaagataacttagttctaactcctgctgctgttttacagatcaaatctctggagacagaaactattctcttaaaattatgtagattcatgagtttggttaaggataaatgtacatagctcacatcccctcagtctctccctatagtccaaagttgttgagcaaggaatctgtagagtattgatttaaattgattaagttacatgtttatgaaactctaagagactagttttagaaatttcactgtaatttctgctgggataaatttgttagcctgggatatcttccaaagataaggcggatgctcaaatatgtgtaaattcatgcaactgttaacagagactgtgctgtaaggagtacttatgtcctatagtaattttattaaacaaatacatgtatgtctccttttgatgtgtacagaaatatactgtttaatctgaagaagctgattgaaacaggaaaaatttaaaaagtaaaaacactcaacccatgtaatactttatttttataacaaggtgttctctttaatacgcctattagattatcctgaagttctctatttactcttactttaaaaaaaatccaatgaaagaaaatttcagtaaagtttgttttgctagaagaatcaggattcttgtactgagttgtctaataatatgaatcaaattgatttacactgaatgaactagctcttgatttggtaaaattcaacaagcatttattaggtgctttcagaaataccaagatgcagcaaacactggcaactaataaaaaaaattacaagta

SEQ ID NO: 105893 - DNA, 887 bp, Homo sapiens
  Payload ID: 762
  Gene Symbol: ART4
  Gene Name: ADP-ribosyltransferase 4 (Dombrock blood group)
  ENST ID: ENST00000420600
  CDS Start-End: 1-822
cctcctgcaacgatgagaatctggctccttggaggcctgctgccattcctgctgctcctctctggcctgcagagacccacagagggttctgaggttgcaattaaaatcgacttcgacttcgcaccaggttcttttgatgatcagtaccaaggctgtagcaaacaggttatggagaaactaactcaaggggattatttcacaaaagacatagaagcccagaagaattattttaggatgtggcaaaaagcccacttagcctggcttaaccaaggaaaagttctaccccagaacatgactaccacacacgctgtggctattttgttttatacattgaacagcaatgttcattctgactttactagagccatggcctctgttgccaggactccacagcagtatgaacgttcattccacttcaaatatttacactactacctcacctcagcaatccagctgctgaggaaagacagcatcatggagaatggcactctgtgctatgaggtgcattataggacgaaggatgtccactttaatgcctacacaggggccaccattcgatttggccaattcctctccacatccctcctgaaagaagaggcacaggagtttgggaaccagacactatttaccatattcacctgcctgggtgcacctgtacagtacttctccctcaagaaggaagtcttgatccctccctatgagctgtttaaagttataaatatgagctaccacccaagaggagactggttgcagttgaggtcaactgggaacctgagcacatataactgtcagctgctaaaaggtattctttatctaaattgaggccactcaggatcacagaccactgctcttttataaaagttattttttctcagtgggtttttggg

SEQ ID NO: 105894 - DNA, 274 bp, Homo sapiens
  Payload ID: 762
  Gene Symbol: ART4
  Gene Name: ADP-ribosyltransferase 4 (Dombrock blood group)
  ENST ID: ENST00000430129
  CDS Start-End: 1-198
cctcctgcaacgatgagaatctggctccttggaggcctgctgccattcctgctgctcctctctggcctgcagagacccacagagggttctgaggttgcaattaaaatcgacttcgacttcgcaccaggttcttttgatgatcagtaccaaggctgtagcaaacagcttccagcaagaaatgcatccctgatcctatagctattgcatctctctcctttttgaccagtgtcatcatcttttccaaaagcagagtataaagaaatcttgtggctcc

SEQ ID NO: 105895 - DNA, 202 bp, Homo sapiens
  Payload ID: 762
  Gene Symbol: ART4
  Gene Name: ADP-ribosyltransferase 4 (Dombrock blood group)
  ENST ID: ENST00000544616
  CDS Start-End: 1-126
cctcctgcaacgatgagaatctggctccttggaggcctgctgccattcctgctgctcctctctggcctgcagagacccacagagggttctgagcttccagcaagaaatgcatccctgatcctatagctattgcatctctctcctttttgaccagtgtcatcatcttttccaaaagcagagtataaagaaatcttgtggctcc

SEQ ID NO: 105896 - DNA, 1241 bp, Homo sapiens
  Payload ID: 763
  Gene Symbol: ART5
  Gene Name: ADP-ribosyltransferase 5
  Uniprot ID: Q96L15
  ENST ID: ENST00000359918
  CDS Start-End: 142-1017
gtcgggttaccagcgcgggggctacagttagcctcgagaacctttgctttcagccggactccggactcctccggggacagcgcagcgcccgccagagccctcggcgctccctcccgctggcggcttccgcagccttcaaggatggcgctggcggctttgatgatcgccctcggcagcctcggcctccacacctggcaggcccaggctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtg

SEQ ID NO: 105897 - DNA, 1154 bp, Homo sapiens
  Payload ID: 763
  Gene Symbol: ART5
  Gene Name: ADP-ribosyltransferase 5
  Uniprot ID: Q96L15
  ENST ID: ENST00000397067
  CDS Start-End: 131-850
aatcctggacccgggatcccgtgcgcctggagacagggtccagatctgcctccagcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggggagaagaggcggggctgtgtgtctgcgccaggggtgcagctagggtcacaatctgagggggcctcctctctgcccccctggaagactctgctcttggcccctggagagttccagctctcaggggttgggccctgaaagtccaacatctgccacttaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtgga

SEQ ID NO: 105898 - DNA, 1504 bp, Homo sapiens
  Payload ID: 763
  Gene Symbol: ART5
  Gene Name: ADP-ribosyltransferase 5
  Uniprot ID: Q96L15
  ENST ID: ENST00000397068
  CDS Start-End: 394-1269
cggactcctccggggacagcgcagcgcccgccagagccctcggcgctccctcccgctggcggcttccgcagccttcaagtgggtcctccgcccccggccctcccctctcaggcggagccaaactgcggccccgcctttacagtctcggaaaggtccccagactggaggctctgaggaaggggtgtggggagtcgggggcggagacttggggcggggggcgggcaataaactcccaggccccgcccacgccccgccggggccctaatcctggacccgggatcccgtgcgcctggagacagggtccagatctgcctccagcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtggagacatggaa

SEQ ID NO: 105899 - DNA, 844 bp, Homo sapiens
  Payload ID: 763
  Gene Symbol: ART5
  Gene Name: ADP-ribosyltransferase 5
  ENST ID: ENST00000453353
  CDS Start-End: 1-793
ggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggagactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggggtgcagctagggtcacaatctgagggggcctcctctctgcccccctggaagactctgctcttggcccctggagagttccagctctcaggggttgggccctgaaagtccaacatctgccacttaggagccctgggaacgggtgaccttcatatg

SEQ ID NO: 105900 - DNA, 455 bp, Homo sapiens
  Payload ID: 763
  Gene Symbol: ART5
  Gene Name: ADP-ribosyltransferase 5
  ENST ID: ENST00000425767
  CDS Start-End: 1-455
gctgttcccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtc

SEQ ID NO: 105901 - DNA, 3466 bp, Homo sapiens
  Payload ID: 764
  Gene Symbol: ADRBK1
  Gene Name: adrenergic, beta, receptor kinase 1
  Uniprot ID: P25098
  ENST ID: ENST00000308595
  CDS Start-End: 291-2360
ggaggcggcggcggctccggggcgcgggcgcgcgggcggcggcggcggcggcgccccgactgcagtcccggcgggagcggagcgcgagccggggccgggcccgagccggcgccatggggcggcgccgcctgtgagcggcggcgagcggagccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatcctgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctga

SEQ ID NO: 105902 - DNA, 1458 bp, Homo sapiens
  Payload ID: 764
  Gene Symbol: ADRBK1
  Gene Name: adrenergic, beta, receptor kinase 1
  ENST ID: ENST00000526285
  CDS Start-End: 220-1446
cgggagcggagcgcgagccggggccgggcccgagccggcgccatggggcggcgccgcctgtgagcggcggcgagcggagccgcgggcgccgagcagggccaggcgggaggcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatcctgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggctcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgttt

SEQ ID NO: 105903 - DNA, 9103 bp, Homo sapiens
  Payload ID: 765
  Gene Symbol: ADRBK2
  Gene Name: adrenergic, beta, receptor kinase 2
  Uniprot ID: P35626
  ENST ID: ENST00000324198
  CDS Start-End: 193-2259
ggccggctacagcctgcggcgcgcgcagagcgctagtggggcgcgcggcgcgcgcgcggggcgggggcgcgcggaggggggggctgccccggggcggcccccccaggtcggggcgcggcgggcggcggcggcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgttgaaacacacacacacacacacacacacacacacacacactccagaagcagaaaagccattgttcttaaagagtgaatgtcttcccagccctggttaattatagctgtgactgatgccgttcccgtctgcatctcaagctcataggttctcagcatgtgcagttgaggatgcgctgggcctcatgcctgttctagatctccaggataaagggcctgctgttgactccaccagggtctgggcttagcgtctaatatctcgtacctagggcgtgagctgcacaaacgtgttcagaaagattattcaactttcccatacttgttctaaaattgagctgatccgcatctctttcaaaaactagaatttctgctctaagaatagaacataaggctccactcccttttagaaaagatatatgaattggaaaatgctctgaaagtccttttgcttcaaacaaaagtgtaaacttttacacttccccaactcacatttgatttgtaatgatatggttgagaagtacatctagatgtcatttattaaaagtgctttgtaagactagattgagctgtttctgagggcggtcaccagttgtgttggggtctggtttgagtgccttctgccaaaatgttgtgatggaggtgtttctgcgaccagacacaggataccgctgtgtctgcacccggttgcctgcatggccagaggaaaagtcagttggattaaacatcatggtatacttggctgttgtttttttttaattttttaattttttgggatagggcctcgctctgtcacccaggctggagaacagtgggatgatcatggctcactgcagccttgaattcctaggttcaagcaatcctcccacgtcagcctcctgagtagctaggactacaggtgcatgccacctttcctggctaatttattttttgggtagagatggggtcttgaactcttaggctcaagtgatcctccttccttggcctcccaaaatgctggaattagagatgtaagccaccatgcccagccatagtacttggatgttttagaaggttttccaagtattacataattcctagatgttcacccttattacactccaactattaaaaaggtcaaaattcagcctattttttttcattattttagattcctgtggttgggatattttaacattgatgagaaaaataattgaggttgatatttttacaaaatcatgcggtaataagtcttgatttcatgattcaaaagaatcaataaagcctaaaaataatagattactttaagctgctatgtaagatatatatggaataaattaaaaacctttgtgaattcaggtttattatttttaacctaaaacattctctttggttcattcatcccctcatgtcatgggggctcattggttttccttctttgtcatatttaagtatgatttttcaacaaaacttctagaagtcagcttattatgtcaccattcatgcaaagtgctcatgcctctgattggtccattcactgacgtgacaatttcaggtcctatgtttaaaaagaaggggctggccgggcacgatggctcacgcctataatcccagcactttgggaggccgagaggggcggttcacgaggtcaggagattgagaccatcctggttagcagagtgaaaccccgtctctactaaaaatacaaataaaaattagccgggcgtggtggcgggcgcctgtagtcccagctacttgggaggctgaggcaggagaatggcatgaacccgggaggcagagcttgcagtgagccgagattgcgccactgcactccagcctgggcgacagagcgagactctgtctcaaaaaaaaaaaggaggggggctaaatatccagtgagatgcactgaggaaaggaagcattttgctgaagacagcagcagcaacaaacaatggtctgtttgttgcaaacaagatgtagcttgatttctggtctgacatatgccatatacagatattagaaacgactgtttgaaggccacactggtcatctacaaagtaatgtttaccaattgacgacagggatttaactagattaaaaagatcaaagtgtggtttttctctgctttttaaaatttcactcggaatttgtagctgggccaattcaacacattttacttttcagtggaattgatttttctaatgtttcagaattttaacatatcaagaagaaaacaacgttctcaaagtctggcctctttagcatgatgtaaacctatagaaatgctttgaaatgtgctggtgtaagataagagttatcttgtatgatttaatcatatgcagtgttgtctcagttacgttcagggaaatgtttctgtgtcattcagagatgcttgatgaattaacacctcccaccctgagtgaggggttgacttgttgggagatgatttgggcttcactgggatctgtgacaggtgggggctgggctgggtgtcacaaagagaatagtggtagaaatcgggcgaaggaagaaagaagttactggtaaaaatcattacaccataaagcaccaaggaaataactgagttaaaataggtgaagtttcttttttcccccctgtaacaggagagttttccttatgataattattctgagacttggtcactttgtttttgaatgtggagctgctgaactcattcagaagccatttgctgcctatcaggactttctgaagaagttcttttgcctctgcctaccctctggcaccctcccatggaggcacaggggacccagagctaaagcattaccaggccatctccaaaacaccccgtgtgtgtgtgtgtgtgtgtgtgtgtgtgtgtgtgtgtgtgtgtgcactttgcagcccccgaggtggagaggcagtgtctggatcactgtgaatgcattgccccattggtcagttggggacactgttacaaatccactgaagtcctggtaaaactgtcaagagtaacaggcctcttctgttctaccctgctcacttccacggtgagttaccagcctgggcaacacagcaagaccccatctctacaaaaaaaatttttttaagtaattaaccgtttaaattttttcctaaagatttaacatgatttttccctcctatgtaaagtttactggagagacttgaattacttaaattcatgttaatatgatttttttttaatccaggtcacattttaacaaagtttattatgaaacaaatgaaatttgaactctaaaatggtactccttggcttcctcaagtcacaatgaactttatattttctttgtccttaaggactaagatagttgttttatttcagccgaatcacagagataaccactcctgcaggcccccacagctggcccaaaggggctgtctttctgacctggctgtgttagcactgattgagaaacgcaggctcccaaattttaaattgcctttattaaaaacacaaactacagaaaatgggttaagagtatacgcatttcatcaaacacatataggggaaaaaatccttcaatttagagttaaataactcagctttgtatagtagagttagcgctccagtatctaacaatctcagaatcatctctgaaaactggtaactatgcttccatttttaattttgtcctaaatatcagatgtctttgatgtaagggtagggaatggagaaatattttcaattgtgtatttgtattacaaagaacttgaaatttactttcttagttgattatattaaatgatgtatatattatatgtggtttataagctcaacactggccatttttttagttttattgttaaatggtatttttctatgtttaattataatagatctggctttttctggatagcataaagatcactgaactatatatatataagaaacaagagttctattttagcacaaaggcattttatattatttattgaatccataagtttgttttcgtcaaaaacattccatattatttctgctcctttttatttgtatagtttgttatttaaagaaatggcagtccttcctgttcttaatacaataaaattgaaataatgcacctagtaatgtggccgacatctcttctcaccaccatggactgttttcaacaacagttgatcttctggtctgtgctgagaggcgcatgcatgtctttcgtcacgtcgggcagcacacctgctgtgaaatactgctttcatctacctcttcagaaggcttcttgcttgttgacaagtaccgcaaaggctttattctggactggctatctcataaaaggatttctgtaagactttgcagtgtcattccctcagaacctaggtttgtttctaaagccacggtattgtccaggagcccctgtgtgtggggcaggtagctatccctcccatgtcattagtaatcctttaggatttaaggtacaactggacagcatcattccttccccttattgtgccaaatccccaccatcagccttgccattgccttaagatttgattattgcacccaattacctaaccactaaacagaaaggccaccttcactctttgaaaaaggcaagctgtgcttagaaacactgcttttaagagtagcacatttgagtgtgactttttccccccttcactatttcaaaatggttttgaaatggggtcttaaaggtaagcgccctcatacatgactgaaactttgtgagaggtcttatatttgaatggacccttaatgatttatgtgaaatagaatgaagtcctgtctctgtgagagaacgtgcctcctcactcatttgtctctgtctgttttcatagccatcaatatagtaacatatttactatattcttgaatacccttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctccacgtctgaggtcacctgccctgtgtggggcacaccaccgtcagcaccaccgtttttacagttactttggagctgctagactggttttctgtgttggtaaattgcctatataaatctgaataaaaaggatctgtacaaaga

SEQ ID NO: 105904 - DNA, 657 bp, Homo sapiens
  Payload ID: 765
  Gene Symbol: ADRBK2
  Gene Name: adrenergic, beta, receptor kinase 2
  ENST ID: ENST00000455558
  CDS Start-End: 1-138
accccggccgcccgcgccagcaagaggatcgtcctgccggagcccagtatccggagtgtgatgcagaagtaccttgcagagagaaatgaaataacctttgacaagattttcaatcagaaaattgataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggatgtttcaaaacaacgccacaaataacattcctccctccctgacccgtgct

SEQ ID NO: 105905 - DNA, 2873 bp, Homo sapiens
  Payload ID: 765
  Gene Symbol: ADRBK2
  Gene Name: adrenergic, beta, receptor kinase 2
  ENST ID: ENST00000619906
  CDS Start-End: 89-1252
ggggcgcgcggaggggggggctgccccggggcggcccccccaggtcggggcgcggcgggcggcggcgccgccgccaaagctcgccaacatggcggacctggaggctgtgctggccgatgtcagttacctgatggccatggagaagagcaaggcgaccccggccgcccgcgccagcaagaggatcgtcctgccggagcccagtatccggagtgtgatgcagaagtaccttgcagagagaaatgaaataacctttgacaagattttcaatcagaaaattggtttcttgctatttaaagatttttgtttgaatgaaattaatgaagctgtacctcaggtgaagttttatgaagagataaaggaatatgaaaaacttgataatgaggaagaccgcctttgcagaagtcgacaaatttatgatgcctacatcatgaaggaacttctttcctgttcacatcctttctcaaagcaagctgtagaacacgtacaaagtcatttatccaagaaacaagtgacatcaactctttttcagccatacatagaagaaatttgtgaaagccttcgaggtgacatttttcaaaaatttatggaaagtgacaagttcactagattttgtcagtggaaaaacgttgaattaaatatccatttgaccatgaatgagttcagtgtgcataggattattggacgaggaggattcggggaagtttatggttgcaggaaagcagacactggaaaaatgtatgcaatgaaatgcttagataagaagaggatcaaaatgaaacaaggagaaacattagccttaaatgaaagaatcatgttgtctcttgtcagcacaggagactgtcctttcattgtatgtatgacctatgccttccataccccagataaactctgcttcatcctggatctgatgaacgggggcgatttgcactaccacctttcacaacacggtgtgttctctgagaaggagatgcggttttatgccactgaaatcattctgggtctggaacacatgcacaatcggtttgttgtctacagagatttgaagccagcaaatattctcttggatgaacatggacacgcaagaatatcagatcttggtcttgcctgcgatttttccaaaaagaagcctcatgcgagtgttggcacccatgggtacatggctcccgaggtgctgcagaaggggacggcctatgacagcagtgccgactggttctccctgggctgcatgcttttcaaacttctgagaggatgaagaattgatactgaaggtttctatgtggctgacagtcactaaaccaacaagtcacaacttgaacccagcttttctgactctggagtcgggttctgcacagggaaaacaggaagcgctcagagctgtggagaatctgctggtgcacgtcacagccctttcagacaacataaaaccaaagacaagcatgaaattgaccgaatgacactcaccgtgaatgtggaacttccagacaccttctctcctgaactgaagtcccttttggagggcttgcttcagcgagacgttagcaagcggctgggctgtcacggaggcggctcacaggaagtaaaagagcacagctttttcaaaggtgttgactggcagcatgtctacttacaaaagtacccaccacccttgattcctccccggggagaagtcaatgctgctgatgcctttgatattggctcatttgatgaagaggataccaaagggattaagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaagattacgctctggggaaggactgtattatgcacgggtacatgctgaaactgggaaacccatttctgactcagtggcagcgtcgctatttttacctctttccaaatagacttgaatggagaggagagggagagtcccggcaaaatttactgacaatggaacagattctctctgtggaagaaactcaaattaaagacaaaaaatgcattttgttcagaataaaaggagggaaacaatttgtcttgcaatgtgagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatg

SEQ ID NO: 105906 - DNA, 2281 bp, Homo sapiens
  Payload ID: 766
  Gene Symbol: ADRA1A
  Gene Name: adrenoceptor alpha 1A
  Uniprot ID: P35348
  ENST ID: ENST00000276393
  CDS Start-End: 437-1837
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatggggtgggtggtagacccaactcatcaggcagcgggtagggcacagggaagagggagggtgtctcacaaccaaccagttcagaatgatacggaacagcatttccctgcagctaatgctttcttggtcactctgtgcccacttcaacgaaaaccaccatgggaaacagaatttcatgcacaatccaaaagactataaatataggattatgatttcatcatgaatattttgagcacacactctaagtttggagctatttcttgatggaagtgaggggattttattttcaggctcaacctactgacagccacatttgacatttatg

SEQ ID NO: 105907 - DNA, 1765 bp, Homo sapiens
  Payload ID: 766
  Gene Symbol: ADRA1A
  Gene Name: adrenoceptor alpha 1A
  Uniprot ID: P35348
  ENST ID: ENST00000354550
  CDS Start-End: 201-1568
tcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggaggggaatggattgtagatatttcaccaagaattgcagagagcatatcaagcatgtgaattttatgatgccaccgtggagaaagggttcagaatgctgatctccaggtagctggagacctaggcagtctgcaaatgaggagtcagctggaagctatggctatgtattatgtgacatcgcttgttcctaagtgaaaactggatatcccaaccttctggcccagtaggtttcatggttaagacctggtagtgagaacattttaggaactatttgcttgggcaggcaatttttcactct

SEQ ID NO: 105908 - DNA, 1697 bp, Homo sapiens
  Payload ID: 766
  Gene Symbol: ADRA1A
  Gene Name: adrenoceptor alpha 1A
  Uniprot ID: P35348
  ENST ID: ENST00000380572
  CDS Start-End: 437-1465
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgatgaggaaactgaggcccaagaaggaaaaaatgactcacccagctttaaacaaccagttcaccatgcagcagtgctggggttggaggtgatggagaaggaaaatttggaaggtgtttcaaggaaagacacctgtggggtttggtgaccagttggaatgtaagaggcaaaaaaaagggagaaggaactagatacatattcttctggcaggaactgttaattgggttcctgctcccatcttgcactacagtgagagagataacctggtctcctaccattggaaagcatatcatctgtgctctggaggatgagacaatcaaagaaaacaagtaaataagaaaacttaaaaactgtgatatgtaccgtgaaataaataagcc

SEQ ID NO: 105909 - DNA, 2548 bp, Homo sapiens
  Payload ID: 766
  Gene Symbol: ADRA1A
  Gene Name: adrenoceptor alpha 1A
  Uniprot ID: P35348
  ENST ID: ENST00000380573
  CDS Start-End: 1025-2425
acgtcagcgagagctgcaaagttccttgctattcttttctggtgtcggggagctgaatattaaaagggtgattgtggagttaccggttatctgcatttttttttcttttcttattttgactctttttaaaaaatgcaggtaaagtgacagcggttcaggagcttaaagacatcagtggtggaggggtgagtcagcgggtgcaaaaggacaaggatttggtgcctcggagacacggtcccctctccgcctccagagaagagcaggcaggcagctcccgggaccgaagccgggtccacatcccccgcgcgcgagctggtggctcagcagcggcgcttcaggtggacgcggtcaaacgatgccccgcagcctcctgggtctcagcacatattccacacctacgtcccctgacctgtgctcctagaagctggagagagcaggagccttcggtggggcagctcaaaatgtaggtaactgcgggccaggagcagcgcccaacctgtagcgctgcgctacccaaccatcggtccctgcctttgagcgtcgacggctgatcttttggtttgagggagagactggcgctggagttttgaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccgggtgagaagtaaaagctttttgcaggtctgctgctgtgtagggccctcaacccccagccttgacaagaaccatcaagttccaaccattaaggtccacaccatctccctcagtgagaacggggaggaagtctaggacaggaaagatgcagaggaaaggggaataatcttaggtacccaccccacttccttctcggaaggccagctcttcttggaggacaagacaggaccaatcaaagaggggacctgctgggaatgg

SEQ ID NO: 105910 - DNA, 2089 bp, Homo sapiens
  Payload ID: 766
  Gene Symbol: ADRA1A
  Gene Name: adrenoceptor alpha 1A
  Uniprot ID: P35348
  ENST ID: ENST00000380582
  CDS Start-End: 437-1726
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 105911 - DNA, 2304 bp, Homo sapiens
  Payload ID: 766
  Gene Symbol: ADRA1A
  Gene Name: adrenoceptor alpha 1A
  Uniprot ID: P35348
  ENST ID: ENST00000380586
  CDS Start-End: 437-1864
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggacgaagtctcgctctgtcaccaggctggagtgcagtggcatgatcttggctcactgcaacctccgcctcccgggttcaagagattctcctgcctcagcctcccaagcagctgggactacagggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagaaccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 105912 - DNA, 1877 bp, Homo sapiens
  Payload ID: 766
  Gene Symbol: ADRA1A
  Gene Name: adrenoceptor alpha 1A
  Uniprot ID: P35348
  ENST ID: ENST00000521711
  CDS Start-End: 437-1411
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggacatacattcttaaatatgacgtgctgttttggagaaaagggctgtcggtctgcactaggctgcgggagaggaaagagattaaaaactgaaaccagggcagggatgagtgtgctatccacagctgagaagtgaaacacccatgtttaatagggactgacccaggaaaatcagggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgag

SEQ ID NO: 105913 - DNA, 1838 bp, Homo sapiens
  Payload ID: 766
  Gene Symbol: ADRA1A
  Gene Name: adrenoceptor alpha 1A
  ENST ID: ENST00000519229
  CDS Start-End: 8-1291
tgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctctgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggtcttctggattttgagaagcagctgcaaggatgaacggattggtgttggcccaaattaaaaagaagagtattcagttctttcagtgtttggagaaagaagaccaaaagcatcatctcacagggagcagaatgtgaccagcctggctaatgaggaaatgagagggatcctcaacttgagaacccgctctactgaagtctgaacttggaaaaatggacacattgggtttggagtaagaattcttactctacaaaaggataaaattgtgatcacattgatgcatgatgcctaggatattaaaaatgcatgattaattaaatgttagtctaccttgtgttttaaagggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacagg

SEQ ID NO: 105914 - DNA, 2092 bp, Homo sapiens
  Payload ID: 766
  Gene Symbol: ADRA1A
  Gene Name: adrenoceptor alpha 1A
  Uniprot ID: P35348
  ENST ID: ENST00000519096
  CDS Start-End: 437-1411
gaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggacatacattcttaaatatgacgtgctgttttggagaaaagggctgtcggtctgcactaggctgcgggagaggaaagagattaaaaactgaaaccagggcagggatgagtgtgctatccacagctgagaagtgaaacacccatgtttaatagggactgacccaggaaaatcagacgaagtctcgctctgtcaccaggctggagtgcagtggcatgatcttggctcactgcaacctccgcctcccgggttcaagagattctcctgcctcagcctcccaagcagctgggactacagggatgtgccaccaggccgacgccaccaggcccagctaatttttgtatttttagtagagacggggtttcaccatgttggccaggatgatctcgatctcttgacctcatgatctgcctgcctcagcctcccaaagtgctgggattacaggcgtgagccaccgtgcccggcccaactattttttttttttatcttttttaacagtgcaatcctttctgtggatgaaatcttgctcagaagctcaatatgcaaaagaaagaaaaacagcagggctggacggatgttgggagtggggtaagaccccaaccactcagaaccacccccccaacacacacacacattctctccatggtgactggtgaggggcctctagagggtacatagtacaccatggagcacggtttaagcaccactggactacacattcttctgtggcagttatcttaccttcccatagacacccagcccatagccattggtt

SEQ ID NO: 105915 - DNA, 1738 bp, Homo sapiens
  Payload ID: 767
  Gene Symbol: ADRA1B
  Gene Name: adrenoceptor alpha 1B
  Uniprot ID: P35368
  ENST ID: ENST00000306675
  CDS Start-End: 124-1686
gccaggagggcgcctctgggaagaagaccacgggggaagcaaagtttcagggcagctgaggagccttcgccgcagcccttccgagcccaatcatccccctggctatggagggcggactctaagatgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtggggggga

SEQ ID NO: 105916 - DNA, 2728 bp, Homo sapiens
  Payload ID: 768
  Gene Symbol: ADRA1D
  Gene Name: adrenoceptor alpha 1D
  Uniprot ID: P25100
  ENST ID: ENST00000379453
  CDS Start-End: 118-1836
ccgacgggacccgtgcgcggagctgcatctggagccccgcggctatgccctgtgctcccctccctgccggccgctcgttctgtgccccggcccggccaccgacggccgcgcgttgagatgactttccgcgatctcctgagcgtcagtttcgagggaccccgcccggacagcagcgcagggggctccagcgcgggcggcggcgggggcagcgcgggcggcgcggccccctcggagggcccggcggtgggcggcgtgccggggggcgcgggcggcggcggcggcgtggtgggcgcaggcagcggcgaggacaaccggagctccgcgggggagccggggagcgcgggcgcgggcggcgacgtgaatggcacggcggccgtcgggggactggtggtgagcgcgcagggcgtgggcgtgggcgtcttcctggcagccttcatccttatggccgtggcaggtaacctgcttgtcatcctctcagtggcctgcaaccgccacctgcagaccgtcaccaactatttcatcgtgaacctggccgtggccgacctgctgctgagcgccaccgtactgcccttctcggccaccatggaggttctgggcttctgggcctttggccgcgccttctgcgacgtatgggccgccgtggacgtgctgtgctgcacggcctccatcctcagcctctgcaccatctccgtggaccggtacgtgggcgtgcgccactcactcaagtacccagccatcatgaccgagcgcaaggcggccgccatcctggccctgctctgggtcgtagccctggtggtgtccgtagggcccctgctgggctggaaggagcccgtgccccctgacgagcgcttctgcggtatcaccgaggaggcgggctacgctgtcttctcctccgtgtgctccttctacctgcccatggcggtcatcgtggtcatgtactgccgcgtgtacgtggtcgcgcgcagcaccacgcgcagcctcgaggcgggcgtcaagcgcgagcgaggcaaggcctccgaggtggtgctgcgcatccactgtcgcggcgcggccacgggcgccgacggggcgcacggcatgcgcagcgccaagggccacaccttccgcagctcgctctccgtgcgcctgctcaagttctcccgtgagaagaaagcggccaagactctggccatcgtcgtgggtgtcttcgtgctctgctggttccctttcttctttgtcctgccgctcggctccttgttcccgcagctgaagccatcggagggcgtcttcaaggtcatcttctggctcggctacttcaacagctgcgtgaacccgctcatctacccctgttccagccgcgagttcaagcgcgccttcctccgtctcctgcgctgccagtgccgtcgtcgccggcgccgccgccctctctggcgtgtctacggccaccactggcgggcctccaccagcggcctgcgccaggactgcgccccgagttcgggcgacgcgccccccggagcgccgctggccctcaccgcgctccccgaccccgaccccgaacccccaggcacgcccgagatgcaggctccggtcgccagccgtcgaaagccacccagcgccttccgcgagtggaggctgctggggccgttccggagacccacgacccagctgcgcgccaaagtctccagcctgtcgcacaagatccgcgccgggggcgcgcagcgcgcagaggcagcgtgcgcccagcgctcagaggtggaggctgtgtccctaggcgtcccacacgaggtggccgagggcgccacctgccaggcctacgaattggccgactacagcaacctacgggagaccgatatttaaggaccccagagctaggccgcggagtgtgctgggcttgggggtaagggggaccagagaggcgggctggtgttctaagagcccccgtgcaaatcggagacccggaaactgatcagggcagctgctctgtgacatccctgaggaactgggcagagcttgaggctggagcccttgaaaggtgaaaagtagtggggccccctgctggactcaggtgcccagaactcttttcttagaagggagaggctgcgggctccgtggggccttttgctcccaatccctatttgagaaacactgccccatcctccatgccctgaaccctgagtagacagccccaagcatggccaggaaggcctgcccctcctcttctgggaaataggcacagaagctttggccggctaccccagtgcctcccttagggaaaaagtcagtgggaccagggctcctcagtggacaaatttctccttcttactgccaactggaggaacccagtggacctaccaccacccacaagctttggtggcagattgtatagccgtcatacaagcctgctgtatttatccatgggcccgctgtccgccacccaggctcctccgtgcacaccccatcacctggcccctaccccttattacttcccctcaagggccttactgtttacactctgtacatagctcatcgtgcctgtgcccatcacttcttgctgggattccaagccaccaattggagagctttatttgtcattttgagacatatttattggtaagagtacttctattttgtccaagctgtgcaaactgtccctctttagcccataacccattaaaaaaaaaatactttttcccctaaagtctgtcaagaactaaaggcccgcaacagaatagattgggtctacatttgc

SEQ ID NO: 105917 - DNA, 3745 bp, Homo sapiens
  Payload ID: 769
  Gene Symbol: ADRA2A
  Gene Name: adrenoceptor alpha 2A
  Uniprot ID: P08913
  ENST ID: ENST00000280155
  CDS Start-End: 835-2232
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtcccggagctccgcacagtgtgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttaaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtcctcttgtctgttatctgagttttcaaaagctttaagactctgggaacatctgattttatggattttttaaaaataaaaaatgtacattataaaaa

SEQ ID NO: 105918 - DNA, 3371 bp, Homo sapiens
  Payload ID: 770
  Gene Symbol: ADRA2B
  Gene Name: adrenoceptor alpha 2B
  ENST ID: ENST00000620793
  CDS Start-End: 97-1449
aggggcgacgctcttgtctagccgagccgggcagcgctgtcgtccacggtgcgcactgggcgggcagcgctccctctgcccacctcccgccccgtcatggaccaccaggacccctactccgtgcaggccacagcggccatagcggcggccatcaccttcctcattctctttaccatcttcggcaacgctctggtcatcctggctgtgttgaccagccgctcgctgcgcgcccctcagaacctgttcctggtgtcgctggccgccgccgacatcctggtggccacgctcatcatccctttctcgctggccaacgagctgctgggctactggtacttccggcgcacgtggtgcgaggtgtacctggcgctcgacgtgctcttctgcacctcgtccatcgtgcacctgtgcgccatcagcctggaccgctactgggccgtgagccgcgcgctggagtacaactccaagcgcaccccgcgccgcatcaagtgcatcatcctcactgtgtggctcatcgccgccgtcatctcgctgccgcccctcatctacaagggcgaccagggcccccagccgcgcgggcgcccccagtgcaagctcaaccaggaggcctggtacatcctggcctccagcatcggatctttctttgctccttgcctcatcatgatccttgtctacctgcgcatctacctgatcgccaaacgcagcaaccgcagaggtcccagggccaagggggggcctgggcagggtgagtccaagcagccccgacccgaccatggtggggctttggcctcagccaaactgccagccctggcctctgtggcttctgccagagaggtcaacggacactcgaagtccactggggagaaggaggagggggagacccctgaagatactgggacccgggccttgccacccagttgggctgcccttcccaactcaggccagggccagaaggagggtgtttgtggggcatctccagaggatgaagctgaagaggaggaagaggaggaggaggaggaggaagagtgtgaaccccaggcagtgccagtgtctccggcctcagcttgcagccccccgctgcagcagccacagggctcccgggtgctggccaccctacgtggccaggtgctcctgggcaggggcgtgggtgctataggtgggcagtggtggcgtcgacgggcgcagctgacccgggagaagcgcttcaccttcgtgctggctgtggtcattggcgtttttgtgctctgctggttccccttcttcttcagctacagcctgggagccatctgcccgaagcactgcaaggtgccccatggcctcttccagttcttcttctggatcggctactgcaacagctcactgaaccctgttatctacaccatcttcaaccaggacttccgccgtgccttccggaggatcctgtgccgcccgtggacccagacggcctggtgagcccgcctgcgctgcccctgtggggttggtgcggtggcgccggggtcaccctgcttcttgccctgctgtgtgtggctgcctcccctgggctttctgctccctgcccagatcctgtaggcctcatcttaggaaccccttgggaggggtgggcaggggggctgctagcaagggtcccagtgaagcttccccttgccggcttagctgtgggggaccccttctccaccctctccctgagcacaggccgatggaggtggttcaaatcctctggaacatagccaagaccaggagaagagagagcactttcttcccagagccccatgctctccagaccaatgtctgggcttccctttcttgaggaccttgtgttcctggcaggtcacttgcttgtggtgttttcgtttctttttcatctcccccccacccacaaagagcacggagccagccttccacttttcccagtggggcctgctgctgagggggaggaagaaacgaagactgatcacccacgctaggcactcgcggtccctggcaggcgctgggatgggggcttatggggtggcatcgtctctgggccctcctttccccctttgcctgttttcggatctgtggttcctttgaaagccagaacaatggatcggcttccttacccagcacccctccggtaggtgggtggccacgtggatgcctcgctggggcggtcttggaggcctggtctctgcctcgacgggagatccccgatcactggcattcaccccctgcaaaaatcggggcgacaatagctcactgcctacttgctgcagggagatgaaaggctttgcagaaagctttgagctctgtgggggaacacactagagaaccaaaaatgtgattatatggtgatataaaaatccctttcctctgtgtttaccaccacctgtcttcctgtagacttttgttctgtccctggggtgtgtgaattcctaccccgaactggaagccgggagtggcagacagaatcactatttcaagttaaaggatctctttgagaatgtgttcttctggctgcaaaggtctgagttattacgctacatgacaacgtttcgacatttcaccggcaacaccaagagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgcccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggttctcagtcccaccccaaaacctggcacccagaacagttggaagtgtggaaaggaggtttatcggccttcccttggagagggcctggcttcaacattgggccagtaggcatcttagcttggcaggtgtcgggggaatgggccagatggacctgctagatttggaagggcaccgagggagttttctgggtgtagagagaatggaggggaccaaaaagagtccttcctggggtgtgggaggcttcccagcttggtcctcagtgggttgttgaggccagagtatcgccctgggatgtggtggggagctgggccaggagagggactgactgtgaccctctgctggccggtcttgtgtgcgccccatgggacccccagtgttcttgcctgtgacctcttattgcgacatgcaggtggtgttttttttttttttaaactctgagctattttatcaataaaggatattttgtaataag

SEQ ID NO: 105919 - DNA, 2129 bp, Homo sapiens
  Payload ID: 771
  Gene Symbol: ADRA2C
  Gene Name: adrenoceptor alpha 2C
  Uniprot ID: P18825
  ENST ID: ENST00000330055
  CDS Start-End: 210-1598
gcagctgcggggagcccggcagccacgctctccggcgcgccgcccgcggagccaccacggccgagggccggctgctgggcgccgcggtccccggcgggcgcgcccgagcagcaggcggcgatgcgggcgccgaccccggctggggggcgcccgagctgccgcggctgcgccccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacagctcgctcaacccggtcatctacacggtcttcaaccaggatttccggcgatcctttaagcacatcctcttccgacggaggagaaggggcttcaggcagtgactcgcacccgtctgggaatcctggacagctccgcgctcggggctgggcagaaggggcggcccggacgggggagctttcccagagacccggggatggattggcctccagggcgcaggggagggtgcggcagggcaggagcttggcagagagatagccgggctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaaccaaactattttctaaataaacctttgtaatctaa

SEQ ID NO: 105920 - DNA, 1600 bp, Homo sapiens
  Payload ID: 771
  Gene Symbol: ADRA2C
  Gene Name: adrenoceptor alpha 2C
  ENST ID: ENST00000509482
  CDS Start-End: 260-1384
ccgcgtcgccgctcgctccgggcgcctcctgctctgcacttacacgctcggcagctgcggggagcccggcagccacgctctccggcgcgccgcccgcggagccaccacggccgagggccggctgctgggcgccgcggtccccggcgggcgcgcccgagcagcaggcggcgatgcgggcgccgaccccggctggggggcgcccgagctgccgcggctgcgccccggctccaggagggacggcgtagctcgcgggaggaccatggcgtccccggcgctggcggcggcgctggcggtggcggcagcggcgggccccaatgcgagcggcgcgggcgagaggggcagcggcggggttgccaatgcctcgggggcttcctgggggccgccgcgcggccagtactcggcgggcgcggtggcagggctggctgccgtggtgggcttcctcatcgtcttcaccgtggtgggcaacgtgctggtggtgatcgccgtgctgaccagccgggcgctgcgcgcgccacagaacctcttcctggtgtcgctggcctcggccgacatcctggtggccacgctggtcatgcccttctcgttggccaacgagctcatggcctactggtacttcgggcaggtgtggtgcggcgtgtacctggcgctcgatgtgctgttttgcacctcgtcgatcgtgcatctgtgtgccatcagcctggaccgctactggtcggtgacgcaggccgtcgagtacaacctgaagcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccagggagtggggaggagagagggggagacccctttgccttcccccctcagcaaggggctgcttctggggctccctgcctggatccagctctgggagccctgccgaggtgtggctgtgaggtcagggttttagagagcagtggcagaggtagccccctaaatgggcaagcaaggagccccccaaagacactaccactccccatccccgtctgaccaagggctgacttctccaggacctagtcggggggtggctgccagggggcaaggagaaagcaccgacaatctttgattactgaaagtatttaaatgtttgccaaaaacaacagccaaaacaa

SEQ ID NO: 105921 - DNA, 2853 bp, Homo sapiens
  Payload ID: 772
  Gene Symbol: ADRB1
  Gene Name: adrenoceptor beta 1
  Uniprot ID: P08588
  ENST ID: ENST00000369295
  CDS Start-End: 78-1511
cgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttgttttttttttcttttcttttctttcttcttcttttttttttttttttttttttctgtttgtggtccggccttcttttgtgtgtgcgtgtgatgcatctttagatttttttcccccaccaggtggtttttgacactctctgagaggaccggagtggaagatgggtgggttaggggaagggagaagcattaggaggggattaaaatcgatcatcgtggctcccatccctttcccgggaacaggaacacactaccagccagagagaggagaatgacagtttgtcaagacatatttccttttgctttccagagaaatttcattttaatttctaagtaatgatttctgctgttatgaaagcaaagagaaaggatggaggcaaaataaaaaaaaatcacgtttcaagaaatgttaagctcttcttggaacaagccccaccttgctttccttgtgtagggcaaacccgctgtcccccgcgcgcctgggtggtcaggctgagggatttctacctcacactgtgcatttgcacagcagatagaaagacttgtttatattaaacagcttatttatgtatcaatattagttggaaggaccaggcgcagagcctctctctgtgacatgtgactctgtcaattgaagacaggacattaaaagagagcgagagagagaaacagttcagattactgcacatgtggataaaaacaaaaacaaaaaaaaggagtggttcaaaatgccatttttgcacagtgttaggaattacaaaatccacagaagatgttacttgcacaaaaagaaattaaatattttttaaagggagaggggctgggcagatcttaaataaaattcaaactctacttctgttgtctagtatgttattgagctaatgattcattgggaaaatacctttttatactcctttatcatggtactgtaactgtatccatattataaatataattatcttaaggattttttatttttttttatgtccaagtgcccacgtgaatttgctggtgaaagttagcacttgtgtgtaaattctacttcctcttgtgtgttttaccaagtatttatactctggtgcaactaactactgtgtgaggaattggtccatgtgcaataaataccaatgaagcacaatcaa

SEQ ID NO: 105922 - DNA, 3443 bp, Homo sapiens
  Payload ID: 773
  Gene Symbol: ADRB2
  Gene Name: adrenoceptor beta 2, surface
  Uniprot ID: P07550
  ENST ID: ENST00000305988
  CDS Start-End: 1588-2829
cccgggttcaagagattctcctgtctcagcctcccgagtagctgggactacaggtacgtgccaccacacctggctaatttttgtatttttagtagagacaagagttacaccatattggccaggatcttttgctttctatagcttcaaaatgttcttaatgttaagacattcttaatactctgaaccatatgaatttgccattttggtaagtcacagacgccagatggtggcaatttcacatggcacaacccgaaagattaacaaactatccagcagatgaaaggattttttttagtttcattgggtttactgaagaaattgtttgaattctcattgcatctccagttcaacagataatgagtgagtgatgccacactctcaagagttaaaaacaaaacaacaaaaaaattaaaacaaaagcacacaactttctctctctgtcccaaaatacatacttgcatacccccgctccagataaaatccaaagggtaaaactgtcttcatgcctgcaaattcctaaggagggcacctaaagtacttgacagcgagtgtgctgaggaaatcagcagctgttgaagtcacctcctgtgctcttgccaaatgtttgaaagggaatacactgggttaccgggtgtatgttgggaggggagcattatcagtgctcgggtgaggcaagttcggagtacccagatggagacatccgtgtctgtgtcgctctggatgcctccaagccagcgtgtgtttactttctgtgtgtgtcaccatgtctttgtgcttctgggtgcttctgtgtttgtttctggccgcgtttctgtgttggacaggggtgactttgtgccggatggcttctgtgtgagagcgcgcgcgagtgtgcatgtcggtgagctgggagggtgtgtctcagtgtctatggctgtggttcggtataagtctgagcatgtctgccagggtgtatttgtgcctgtatgtgcgtgcctcggtgggcactctcgtttccttccgaatgtggggcagtgccggtgtgctgccctctgccttgagacctcaagccgcgcaggcgcccagggcaggcaggtagcggccacagaagagccaaaagctcccgggttggctggtaaggacaccacctccagctttagccctctggggccagccagggtagccgggaagcagtggtggcccgccctccagggagcagttgggccccgcccgggccagccccaggagaaggagggcgaggggaggggagggaaaggggaggagtgcctcgccccttcgcggctgccggcgtgccattggccgaaagttcccgtacgtcacggcgagggcagttcccctaaagtcctgtgcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggcacccaatggaagccatgcgccggaccacgacgtcacgcaggaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgcacctgtttctccaaaaccccttgactggagtgctgttgcctcccccactggaaa

SEQ ID NO: 105923 - DNA, 2950 bp, Homo sapiens
  Payload ID: 774
  Gene Symbol: ADRB3
  Gene Name: adrenoceptor beta 3
  Uniprot ID: P13945
  ENST ID: ENST00000345060
  CDS Start-End: 497-1723
ctctgatacataaagggtggggatgggagcgctctcctctctccttcccctgccttgctgtgggaacttctgggaaaggaggtgcagggctccaggaagccagtgcccagggagtgctatgctgagtccaggagcctggccacggcaggggtggacagatggtggcagaggaaccacggtgtcccttcctccagatttagctaaaggaaacgtggagcatcccattggccatcctccccactctccaattcggctccagaggcccctccagactataggcagctgcccctttaagcgtcgctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccaggtgccgtggagcagcaggctggctttggtaggggcacccatcacccggcttgcctgtgcagtcagtgagtgcttagggcaaagagagctcccctggttccattccttctgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggccccctttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagttacaaatttg

SEQ ID NO: 105924 - DNA, 2642 bp, Homo sapiens
  Payload ID: 774
  Gene Symbol: ADRB3
  Gene Name: adrenoceptor beta 3
  Uniprot ID: P13945
  ENST ID: ENST00000614635
  CDS Start-End: 198-1424
gctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccctgtgcaccttgggtctcatcatgggcaccttcactctctgctggttgcccttctttctggccaacgtgctgcgcgccctggggggcccctctctagtcccgggcccggctttccttgccctgaactggctaggttatgccaattctgccttcaacccgctcatctactgccgcagcccggactttcgcagcgccttccgccgtcttctgtgccgctgcggccgtcgcctgcctccggagccctgcgccgccgcccgcccggccctcttcccctcgggcgttcctgcggcccggagcagcccagcgcagcccaggctttgccaacggctcgacggggcttcttggggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccaggtgccgtggagcagcaggctggctttggtaggggcacccatcacccggcttgcctgtgcagtcagtgagtgcttagggcaaagagagctcccctggttccattccttctgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggccccctttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttacatggtgtgtgtgtgtgtgtgtgcgtgtgtgtgtgtgtgtgtgtgtctggaggcacaggcacaaagcattgcttgggttggtcaaatgtcttgtgtcataaatatattctgatgtttcccagcctttccacaacctctaccttcccactcaccttccccagctacaaaaatctgtattatcctcttaaagtaaaactggagtt

SEQ ID NO: 105925 - DNA, 2052 bp, Homo sapiens
  Payload ID: 775
  Gene Symbol: ACD
  Gene Name: adrenocortical dysplasia homolog (mouse)
  Uniprot ID: Q96AP0
  ENST ID: ENST00000219251
  CDS Start-End: 333-1958
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcaggga

SEQ ID NO: 105926 - DNA, 1974 bp, Homo sapiens
  Payload ID: 775
  Gene Symbol: ACD
  Gene Name: adrenocortical dysplasia homolog (mouse)
  Uniprot ID: Q96AP0
  ENST ID: ENST00000393919
  CDS Start-End: 266-1900
aaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggca

SEQ ID NO: 105927 - DNA, 662 bp, Homo sapiens
  Payload ID: 775
  Gene Symbol: ACD
  Gene Name: adrenocortical dysplasia homolog (mouse)
  ENST ID: ENST00000602382
  CDS Start-End: 1-547
ggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcagga

SEQ ID NO: 105928 - DNA, 883 bp, Homo sapiens
  Payload ID: 775
  Gene Symbol: ACD
  Gene Name: adrenocortical dysplasia homolog (mouse)
  ENST ID: ENST00000602850
  CDS Start-End: 1-51
agtgtccgatgcctggtgacgcgggaggccctggacacctcggactggtgagaggccccgcgcggctctggagggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccg

SEQ ID NO: 105929 - DNA, 1408 bp, Homo sapiens
  Payload ID: 775
  Gene Symbol: ACD
  Gene Name: adrenocortical dysplasia homolog (mouse)
  ENST ID: ENST00000602320
  CDS Start-End: 20-1348
gctgggtgtagccgtggggatggcaggttcggggaggctggtcctacggccctggattcgggagctgattctggggtcagagacaccctccagtccacgagccgggcagctgcttgaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctggtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaat

SEQ ID NO: 105930 - DNA, 1483 bp, Homo sapiens
  Payload ID: 775
  Gene Symbol: ACD
  Gene Name: adrenocortical dysplasia homolog (mouse)
  ENST ID: ENST00000620761
  CDS Start-End: 13-1389
gtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcaggga

SEQ ID NO: 105931 - DNA, 2065 bp, Homo sapiens
  Payload ID: 775
  Gene Symbol: ACD
  Gene Name: adrenocortical dysplasia homolog (mouse)
  Uniprot ID: Q96AP0
  ENST ID: ENST00000620338
  CDS Start-End: 338-1972
gcgtcatcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggttgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcaggg

SEQ ID NO: 105932 - DNA, 1885 bp, Homo sapiens
  Payload ID: 776
  Gene Symbol: ADM
  Gene Name: adrenomedullin
  Uniprot ID: P35318
  ENST ID: ENST00000278175
  CDS Start-End: 572-1129
atccgcgctgtcccttccgcgggctcttgctgttcttcgccaggaggctttgcactccgggccgcatgggtcctggataaggacctcaagaggttgtagtggcgccccttcgctccggcgtactgtctgaaccctgtgcccaaagagggctgtggcagttcctgcaccaaccgcctggagcccatacctaagccctctgggcacgagggacctcctctcccccgctcccccctccccccatcccaactccagccccaaaggaagcaatgcgcgcgtccgagagcaggagcgcgcgtggctgaggaaagaaagggaaggcaaccgggcagcccaggccccgccccgccgctcccccacccgtgcgcttataaagcacaggaaccagagctggccactcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgctga

SEQ ID NO: 105933 - DNA, 1640 bp, Homo sapiens
  Payload ID: 776
  Gene Symbol: ADM
  Gene Name: adrenomedullin
  ENST ID: ENST00000534464
  CDS Start-End: 470-886
actcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaaccaataaactgtctcaatgct

SEQ ID NO: 105934 - DNA, 584 bp, Homo sapiens
  Payload ID: 776
  Gene Symbol: ADM
  Gene Name: adrenomedullin
  ENST ID: ENST00000524948
  CDS Start-End: 175-426
agtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttc

SEQ ID NO: 105935 - DNA, 641 bp, Homo sapiens
  Payload ID: 776
  Gene Symbol: ADM
  Gene Name: adrenomedullin
  ENST ID: ENST00000526492
  CDS Start-End: 164-583
ggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccgg

SEQ ID NO: 105936 - DNA, 586 bp, Homo sapiens
  Payload ID: 776
  Gene Symbol: ADM
  Gene Name: adrenomedullin
  ENST ID: ENST00000528544
  CDS Start-End: 325-576
gtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctg

SEQ ID NO: 105937 - DNA, 867 bp, Homo sapiens
  Payload ID: 776
  Gene Symbol: ADM
  Gene Name: adrenomedullin
  Uniprot ID: P35318
  ENST ID: ENST00000525063
  CDS Start-End: 164-721
ggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcaccgtccggcggcgagctctggctttgcaagggcccctccttctgggggcttcgcttccttagccttgctcaggtgcaagtgccccagggggcggggtgcagaagaatccgagtgtttgccaggcttaaggagagga

SEQ ID NO: 105938 - DNA, 1889 bp, Homo sapiens
  Payload ID: 776
  Gene Symbol: ADM
  Gene Name: adrenomedullin
  Uniprot ID: P35318
  ENST ID: ENST00000528655
  CDS Start-End: 618-1175
tcttggtgacactggatagaacagctcaagccttgccacttcgggcttctcactgcagctgggcttggacttcggagttttgccattgccagtgggacgtctgagactttctccttcaagtacttggcagatcactctcttagcaggtaggtgccgcagaccctgcgggttaagaggtggggtggggggcagtgcttgccaaggccctaaactgggagcgctgggtgaggggaacaacccactttggagggttctctgagagatagatacaccccatatcctgggcccagctcgtgcacacagctggaggtccagagacccagtcccctctgctccgtcagccaagttccaagaagttgagcagagaccctctgggagcctggcggggtgcagcggcctcccctgcggggcctgtcacccggccggcgcgtgcaaacgcctctggcgcctctctgcgcggagggagataagcgtctgagccagggaaagcgcgggctaaacccgcctcgccggggcccctgcccgccctccgtgccccgcccgggcggtgcagctggcccgggtgctcacgctcgactctctttcttcttttccagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgg

SEQ ID NO: 105939 - DNA, 1839 bp, Homo sapiens
  Payload ID: 776
  Gene Symbol: ADM
  Gene Name: adrenomedullin
  ENST ID: ENST00000530439
  CDS Start-End: 765-1118
ctcagtggtttcttggtgacactggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtgagtccgggcagcgccttcccccttgctggtacctggcaggcaaggggaactgaccgttggtcccgaaggtctagaagtgaatgggagcagggacaggcctgggcgtcacctgaacgcacgcgaatcgggtctgcttgtgttttccaggtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacaggtaactacgccctgtgctgtccagggacgggagggaaggaaggtgtgcgggaggagttctctgtctccactcccctggcccgggggatcgtcggggctggaccgcagctcagatggcgcgagcagtttccagctccctctggctctagaatggctcccgttcccggtgttggggccaaagctctgcttgatggggtctcaagttgcctttcttccccctccccccgcccgcagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatat

SEQ ID NO: 105940 - DNA, 535 bp, Homo sapiens
  Payload ID: 777
  Gene Symbol: ADM2
  Gene Name: adrenomedullin 2
  Uniprot ID: Q7Z4H4
  ENST ID: ENST00000395737
  CDS Start-End: 52-498
cgcccacgcccggcgccccgaccgcggaggactccccgagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccag

SEQ ID NO: 105941 - DNA, 4276 bp, Homo sapiens
  Payload ID: 777
  Gene Symbol: ADM2
  Gene Name: adrenomedullin 2
  Uniprot ID: Q7Z4H4
  ENST ID: ENST00000395738
  CDS Start-End: 293-739
attcagccctggaggtgccatcccgggccgcgactccgctccaggcaggacccccaacccgcccagcccgctccgccttgcgccccggacccgcggccgaccccagacccgctgcccgcttcgcgcccgaggcctgcgccccgacggacgcccgtgcccagcttgccacgcccacgcccggcgccccgaccgcggaggactccccgaggtgccggcggagggggtggctcgcggctcaggctgcccccgacgtgcccggctcaccgccccctcccctgcagccccgcccgccatggcccggatcccgacggccgccctgggttgcatcagcctcctctgcctgcagctccctggctcgctgtcccgcagcctgggcggggacccgcgacccgtcaaacccagggagcccccagcccggagcccttccagcagcctgcagcccaggcaccccgcaccccgacctgtggtctggaagcttcaccgggccctccaggcacagaggggtgccggcctggcccctgttatgggtcagcctctccgggatggtggccgccaacactcgggcccccgaagacactcgggcccccgcaggacccaagcccagctcctgcgagtgggctgtgtgctgggcacctgccaggtgcagaatctcagccaccgcctgtggcaactcatgggaccggccggccggcaggactcagctcctgtggaccccagcagcccccacagctatggctgaggtggggccgggccacacccctgcccatcccagccagggtgctgtgcccccgtccagagctgcagctgagccccatctgaagcccagtccctcggagctgcagacagcaggtcctgcagcaacaatacctgcacggctttgcacacgtaaacctaggctggtctacacgcagtgctggtacgtcaaggagcctaaacaccctgaaattgtgaccccctgggggacagctgccagacacagctggcggcagcaccagatgctaagcgcttcagagaggaggtgtctgcccagagatgtggagcagaagctgggccctgaacacacggggccatgtctggacgagcaggggagagaggctgaactggccagaagtggcccctccgctgctggtccagtcagactgaagcccggccttgtgcctgggctgttcctgctctcatgcacaaccagcccttccacgtgcctgcctgtgggacaggagggggagcgtgggatgctgtagcccccggggttgggcaagggaaggatggtggccctccagaggtcatgaagggacctctgtggctccagctgccaaccctggagcccagaccgaggtggccatggagactccacctggatcccctgtaggaggccagggaggggaactcagcagttcaggagccaccccaaaccattctgggacagggacacccctttctaccccagggcagggcagggctgggtggggcaagatcccccagcccgactagacccacctcacctgaagggggtgagacccttgttggcagccagacaagggtggggctccacaggcagcacaggcgccccaccaccacccagtttggggacccagtgggaccaggtgcgggggcagagggtgacttaccaagagccagggagggcagcccaggcccaagtgacagcaagaacaagaaccactgccggcgtgcacagacttggtgtgtgtccttccctggggggacgggggactcacatgtgcctgccactggagcctctcaaccgtccagcagaacacggggttcagaaagggctccttctgctatttagcgaacactgagcatttaatttacaaatgtttgctagggtcaccctctcggccatcccacgagggtcgccatgatcaccccaactctagaggccgcagcagagctcaggacattcccccacagagcttgcccctcagttcctacctccaagggggagggtcctggaagcgcccacccaggcgccgcccctgtgcttgctccccgagctcagggattgccgagtccacgtaactgacctgtactccacgaggccctgtgggaacggtccaggctggtcctgccctgtggaggcctccgtgcactgagagatgtactaggattgcagcaaaggtggtcagggtgatgggccgcacagcgaggcagtcaaggccagctccctgggagaagcactgggtcaggtgaggtctgaggacagcaggccttccctaggggaaggagctgggagtgccaaggccccaggtgcacaggaggcgtggctgctgagaggctgcagggtggaggggcctcggcctcagagtcatgtgccctgtgaccactgaagggtgtcagcagagcacacggcatgaggacagagggaggggcacggggagtgaaggagggggccctggggcaaggctcgggggtcaggagctcagcgtccgctactcagcccagccaaaaccctcccagacgtctcctctcctgcctgggcaaagtccagcttggcaccccgtctggggcctgcctgtggtcagggccaagtgttccctcctccaggaaagcctttaccctcctcatgccctgtagtcaggaggccgcctgctgtaaccctccgtgtcgcctcgggtgcgaaatcagacccacctgacaccatcacgcggaggcccagcagcacctgcacccacttccagctgctctggccaaaatctccgctcggccaggccccgtggctcacacctgtaatcctagcacattgggaggccaaggcaggcacatcacctgagttcaggagttcaagaccagcctggccaacatggtgaaatcccgtctctactaaaaacagaaaattatccgggcgtggtggcacatgactgtaatcccagctactcaggaggctgaggcaggaggatcacttgaacctgggaggcggaggttgcagtgagctgagattgcgccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcagggagtgctgagtgccacaggaagtcagacaaggaaggagagtgtggggcaggtgccgtttaaatggggggcgctggggtctcctcacagttgcttctcagctcagctgtgccaggatcttgttgagtcaggtcagctgcccacagccctcttgcctgacccctgaagcccagaactctgatcttcacagccctaggtatggccccagcaccccactgccctctctcctgccccagccgactgctgttcccagacttccctggccacgctccaagacgccagctctgccgcgggcactttgttctcacggtgtcctccatgcctgcagggcccatgcatgggaagttgcgttggcggcctgggtgttggcggttccgtgcctgctccaactctccgtgaggcccctctcccagagcctgacacactctgtggccgaactctaggcaggtgcccctgagtcctttcctcgacgaggcctgaccccatccccatcctcgctgggcccgccgaccccggtgttagcaagaatcctctaaatcagtttatggagaattacccaccctcgatatctgatcccattcctcatctcccacccttgatctcatcaccctgccggcctcctgcaagatcctcattgagccactccagtgagaatccccctaccctcgaaggccgccctaacaacttcccatccgctgacccctccaacgccatcaatctccagctgtggttgttgaactcggaggtgagctcctctcaccactctcttgaataaagcttttctcaccattttaacaa

SEQ ID NO: 105942 - DNA, 1718 bp, Homo sapiens
  Payload ID: 778
  Gene Symbol: ADM5
  Gene Name: adrenomedullin 5 (putative)
  Uniprot ID: C9JUS6
  ENST ID: ENST00000420022
  CDS Start-End: 1175-1636
gtccaactcttttcatccctctcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgtaaggtggcagggcctacccatcttacagaggtgaagacgaggtccctctgcctctgctgcagacatggcgtctgcacccacccttccaccctcagggcctggccacggggtcctgggtcccccacaatactgtgcactcgacctggttgacccaggacaccctcctcgttgaacagccctggctacacctgcttcagtgcaactggagccctcaccggcgagtgcctgacacctcggccttttctcttccggaggggcgctcctcagtgtgtttggggtctccctcgctccacgccctccagggggccgcatgtgcacttgccctgcattgcctggcccccgaggttccagggtcccaactgtctactaaccggcttcccgacagggtgagggtgaggtcgcatctacaaccagagccagcgcttccccgccgccaccccttttcttggaatcccgctgcttagctacctgcgggtgtcattggccccgccccatttccccacgctttgaagggggcgagtctccacagacctcctagggggatagacagcagctggtgtgaccccacacacccagtgaggtctctggagccgcggtgcgggaagcggggacccgggtttgaatcctgcccctctggtgtggtgcggcctcttcccacagacttttggcctcagtgttccccgcctgggaagtggggactggccctggtacctggctccagagctgcacccagaggcgatcagcccggtgcgggaacggggcggggtggccgcaactacgggccacggatcctgacccgccctgcccacgatgactatccacatcctcatcctgctgttgctcctcgccttctccgcccaaggggacctggacactgcagccaggcgaggccagcaccaggtcccccagcaccgcgggcacgtctgctacctgggcgtatgccggacccaccgcctggcggagatcatatactggattcgctgtctccaccaaggagccctcggggaaggccagccacgagccccaggacccctacagctatgggcgccgccggtggcgcgaggcggaagcccggctcggttcccaggattccggcctgcagcgagggggctagcgcagtgcccagctcgctgggtgacctcgggcacggctcgtcccctcctcggcttcagtttgcctatctgtatgttggagcttctactccacatttcttctcccctaactccagcccctgaaaccgtcttccccagtccctccccgggctgcgactaggttggacctagaagcacacgggaccaggctgggcgaagaacactgacgcccagagccgaataaacaagagttccgtgtttca

SEQ ID NO: 105943 - DNA, 1369 bp, Homo sapiens
  Payload ID: 779
  Gene Symbol: AGER
  Gene Name: advanced glycosylation end product-specific receptor
  Uniprot ID: Q15109
  ENST ID: ENST00000375055
  CDS Start-End: 25-1068
gccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105944 - DNA, 715 bp, Homo sapiens
  Payload ID: 779
  Gene Symbol: AGER
  Gene Name: advanced glycosylation end product-specific receptor
  ENST ID: ENST00000375056
  CDS Start-End: 16-715
ctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 105945 - DNA, 665 bp, Homo sapiens
  Payload ID: 779
  Gene Symbol: AGER
  Gene Name: advanced glycosylation end product-specific receptor
  ENST ID: ENST00000375065
  CDS Start-End: 264-665
atggctgccggaacagcagttggagcctgggtgctggtcctcagtctgtggggggcagtagtaggtgctcaaaacatcacagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 105946 - DNA, 1250 bp, Homo sapiens
  Payload ID: 779
  Gene Symbol: AGER
  Gene Name: advanced glycosylation end product-specific receptor
  Uniprot ID: Q15109
  ENST ID: ENST00000375067
  CDS Start-End: 16-1044
ctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105947 - DNA, 1538 bp, Homo sapiens
  Payload ID: 779
  Gene Symbol: AGER
  Gene Name: advanced glycosylation end product-specific receptor
  Uniprot ID: Q15109
  ENST ID: ENST00000375069
  CDS Start-End: 101-1363
ctgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105948 - DNA, 1463 bp, Homo sapiens
  Payload ID: 779
  Gene Symbol: AGER
  Gene Name: advanced glycosylation end product-specific receptor
  ENST ID: ENST00000375070
  CDS Start-End: 404-1288
ctgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105949 - DNA, 1492 bp, Homo sapiens
  Payload ID: 779
  Gene Symbol: AGER
  Gene Name: advanced glycosylation end product-specific receptor
  Uniprot ID: Q15109
  ENST ID: ENST00000375076
  CDS Start-End: 103-1317
gactgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105950 - DNA, 1369 bp, Homo sapiens
  Payload ID: 779
  Gene Symbol: AGER
  Gene Name: advanced glycosylation end product-specific receptor
  Uniprot ID: Q15109
  ENST ID: ENST00000383275
  CDS Start-End: 25-1068
gccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105951 - DNA, 1250 bp, Homo sapiens
  Payload ID: 779
  Gene Symbol: AGER
  Gene Name: advanced glycosylation end product-specific receptor
  Uniprot ID: Q15109
  ENST ID: ENST00000383279
  CDS Start-End: 16-1044
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105952 - DNA, 1250 bp, Homo sapiens; identical to SEQ ID NO: 105951
  Payload ID: 779
  Gene Symbol: AGER
  Gene Name: advanced glycosylation end product-specific receptor
  Uniprot ID: Q15109
  ENST ID: ENST00000412470
  CDS Start-End: 16-1044

SEQ ID NO: 105953 - DNA, 1493 bp, Homo sapiens
  Payload ID: 779
  Gene Symbol: AGER
  Gene Name: advanced glycosylation end product-specific receptor
  Uniprot ID: Q15109
  ENST ID: ENST00000438221
  CDS Start-End: 101-1192
ctgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105954 - DNA, 716 bp, Homo sapiens
  Payload ID: 779
  Gene Symbol: AGER
  Gene Name: advanced glycosylation end product-specific receptor
  ENST ID: ENST00000436653
  CDS Start-End: 14-716
ggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 105955 - DNA, 1250 bp, Homo sapiens; identical to SEQ ID NO: 105951
  Payload ID: 779
  Gene Symbol: AGER
  Gene Name: advanced glycosylation end product-specific receptor
  Uniprot ID: Q15109
  ENST ID: ENST00000441180
  CDS Start-End: 16-1044

SEQ ID NO: 105956 - DNA, 716 bp, Homo sapiens
  Payload ID: 779
  Gene Symbol: AGER
  Gene Name: advanced glycosylation end product-specific receptor
  ENST ID: ENST00000455471
  CDS Start-End: 14-716
ggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 105957 - DNA, 1250 bp, Homo sapiens; identical to SEQ ID NO: 105951
  Payload ID: 779
  Gene Symbol: AGER
  Gene Name: advanced glycosylation end product-specific receptor
  Uniprot ID: Q15109
  ENST ID: ENST00000441804
  CDS Start-End: 16-1044

SEQ ID NO: 105958 - DNA, 1250 bp, Homo sapiens
  Payload ID: 779
  Gene Symbol: AGER
  Gene Name: advanced glycosylation end product-specific receptor
  ENST ID: ENST00000424145
  CDS Start-End: 16-1044
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105959 - DNA, 715 bp, Homo sapiens
  Payload ID: 779
  Gene Symbol: AGER
  Gene Name: advanced glycosylation end product-specific receptor
  ENST ID: ENST00000424476
  CDS Start-End: 16-715
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 105960 - DNA, 716 bp, Homo sapiens; identical to SEQ ID NO: 105956
  Payload ID: 779
  Gene Symbol: AGER
  Gene Name: advanced glycosylation end product-specific receptor
  ENST ID: ENST00000415973
  CDS Start-End: 14-716

SEQ ID NO: 105961 - DNA, 1492 bp, Homo sapiens
  Payload ID: 779
  Gene Symbol: AGER
  Gene Name: advanced glycosylation end product-specific receptor
  Uniprot ID: Q15109
  ENST ID: ENST00000447921
  CDS Start-End: 103-1317
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105962 - DNA, 1492 bp, Homo sapiens; identical to SEQ ID NO: 105961
  Payload ID: 779
  Gene Symbol: AGER
  Gene Name: advanced glycosylation end product-specific receptor
  Uniprot ID: Q15109
  ENST ID: ENST00000436456
  CDS Start-End: 103-1317

SEQ ID NO: 105963 - DNA, 715 bp, Homo sapiens
  Payload ID: 779
  Gene Symbol: AGER
  Gene Name: advanced glycosylation end product-specific receptor
  ENST ID: ENST00000412794
  CDS Start-End: 16-715
ctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacacc

SEQ ID NO: 105964 - DNA, 1250 bp, Homo sapiens; identical to SEQ ID NO: 105958
  Payload ID: 779
  Gene Symbol: AGER
  Gene Name: advanced glycosylation end product-specific receptor
  ENST ID: ENST00000448768
  CDS Start-End: 16-1044

SEQ ID NO: 105965 - DNA, 716 bp, Homo sapiens
  Payload ID: 779
  Gene Symbol: AGER
  Gene Name: advanced glycosylation end product-specific receptor
  ENST ID: ENST00000450110
  CDS Start-End: 14-716
ggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgaagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgca

SEQ ID NO: 105966 - DNA, 715 bp, Homo sapiens; identical to SEQ ID NO: 105959
  Payload ID: 779
  Gene Symbol: AGER
  Gene Name: advanced glycosylation end product-specific receptor
  ENST ID: ENST00000434502
  CDS Start-End: 16-715

SEQ ID NO: 105967 - DNA, 1369 bp, Homo sapiens; identical to SEQ ID NO: 105950
  Payload ID: 779
  Gene Symbol: AGER
  Gene Name: advanced glycosylation end product-specific receptor
  Uniprot ID: Q15109
  ENST ID: ENST00000453588
  CDS Start-End: 25-1068

SEQ ID NO: 105968 - DNA, 1369 bp, Homo sapiens; identical to SEQ ID NO: 105950
  Payload ID: 779
  Gene Symbol: AGER
  Gene Name: advanced glycosylation end product-specific receptor
  Uniprot ID: Q15109
  ENST ID: ENST00000449037
  CDS Start-End: 25-1068

SEQ ID NO: 105969 - DNA, 1492 bp, Homo sapiens; identical to SEQ ID NO: 105961
  Payload ID: 779
  Gene Symbol: AGER
  Gene Name: advanced glycosylation end product-specific receptor
  Uniprot ID: Q15109
  ENST ID: ENST00000451115
  CDS Start-End: 103-1317

SEQ ID NO: 105970 - DNA, 716 bp, Homo sapiens; identical to SEQ ID NO: 105956
  Payload ID: 779
  Gene Symbol: AGER
  Gene Name: advanced glycosylation end product-specific receptor
  ENST ID: ENST00000444630
  CDS Start-End: 14-716

SEQ ID NO: 105971 - DNA, 1369 bp, Homo sapiens
  Payload ID: 779
  Gene Symbol: AGER
  Gene Name: advanced glycosylation end product-specific receptor
  ENST ID: ENST00000452945
  CDS Start-End: 25-1068
gccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105972 - DNA, 1369 bp, Homo sapiens; identical to SEQ ID NO: 105971
  Payload ID: 779
  Gene Symbol: AGER
  Gene Name: advanced glycosylation end product-specific receptor
  ENST ID: ENST00000426320
  CDS Start-End: 25-1068

SEQ ID NO: 105973 - DNA, 1492 bp, Homo sapiens; identical to SEQ ID NO: 105961
  Payload ID: 779
  Gene Symbol: AGER
  Gene Name: advanced glycosylation end product-specific receptor
  Uniprot ID: Q15109
  ENST ID: ENST00000456918
  CDS Start-End: 103-1317

SEQ ID NO: 105974 - DNA, 715 bp, Homo sapiens; identical to SEQ ID NO: 105959
  Payload ID: 779
  Gene Symbol: AGER
  Gene Name: advanced glycosylation end product-specific receptor
  ENST ID: ENST00000441753
  CDS Start-End: 16-715

SEQ ID NO: 105975 - DNA, 715 bp, Homo sapiens; identical to SEQ ID NO: 105959
  Payload ID: 779
  Gene Symbol: AGER
  Gene Name: advanced glycosylation end product-specific receptor
  ENST ID: ENST00000453119
  CDS Start-End: 16-715

SEQ ID NO: 105976 - DNA, 715 bp, Homo sapiens; identical to SEQ ID NO: 105963
  Payload ID: 779
  Gene Symbol: AGER
  Gene Name: advanced glycosylation end product-specific receptor
  ENST ID: ENST00000418313
  CDS Start-End: 16-715

SEQ ID NO: 105977 - DNA, 716 bp, Homo sapiens; identical to SEQ ID NO: 105956
  Payload ID: 779
  Gene Symbol: AGER
  Gene Name: advanced glycosylation end product-specific receptor
  ENST ID: ENST00000416532
  CDS Start-End: 14-716

SEQ ID NO: 105978 - DNA, 1369 bp, Homo sapiens; identical to SEQ ID NO: 105950
  Payload ID: 779
  Gene Symbol: AGER
  Gene Name: advanced glycosylation end product-specific receptor
  Uniprot ID: Q15109
  ENST ID: ENST00000432831
  CDS Start-End: 25-1068

SEQ ID NO: 105979 - DNA, 1492 bp, Homo sapiens
  Payload ID: 779
  Gene Symbol: AGER
  Gene Name: advanced glycosylation end product-specific receptor
  Uniprot ID: Q15109
  ENST ID: ENST00000426138
  CDS Start-End: 103-1317
gactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105980 - DNA, 716 bp, Homo sapiens; identical to SEQ ID NO: 105954
  Payload ID: 779
  Gene Symbol: AGER
  Gene Name: advanced glycosylation end product-specific receptor
  ENST ID: ENST00000454284
  CDS Start-End: 14-716

SEQ ID NO: 105981 - DNA, 1492 bp, Homo sapiens; identical to SEQ ID NO: 105979
  Payload ID: 779
  Gene Symbol: AGER
  Gene Name: advanced glycosylation end product-specific receptor
  Uniprot ID: Q15109
  ENST ID: ENST00000427822
  CDS Start-End: 103-1317

SEQ ID NO: 105982 - DNA, 487 bp, Homo sapiens
  Payload ID: 779
  Gene Symbol: AGER
  Gene Name: advanced glycosylation end product-specific receptor
  ENST ID: ENST00000538695
  CDS Start-End: 101-487
ctgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 105983 - DNA, 665 bp, Homo sapiens
  Payload ID: 779
  Gene Symbol: AGER
  Gene Name: advanced glycosylation end product-specific receptor
  ENST ID: ENST00000552517
  CDS Start-End: 264-665
atggcagccggaacagcagttggagcctgggtgctggtcctcagtctgtggggggcagtagtaggtgctcaaaacatcacagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttga

SEQ ID NO: 105984 - DNA, 665 bp, Homo sapiens; identical to SEQ ID NO: 105983
  Payload ID: 779
  Gene Symbol: AGER
  Gene Name: advanced glycosylation end product-specific receptor
  ENST ID: ENST00000550441
  CDS Start-End: 264-665

SEQ ID NO: 105985 - DNA, 487 bp, Homo sapiens
  Payload ID: 779
  Gene Symbol: AGER
  Gene Name: advanced glycosylation end product-specific receptor
  ENST ID: ENST00000553014
  CDS Start-End: 101-487
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 105986 - DNA, 1493 bp, Homo sapiens
  Payload ID: 779
  Gene Symbol: AGER
  Gene Name: advanced glycosylation end product-specific receptor
  ENST ID: ENST00000552891
  CDS Start-End: 101-1192
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105987 - DNA, 1538 bp, Homo sapiens
  Payload ID: 779
  Gene Symbol: AGER
  Gene Name: advanced glycosylation end product-specific receptor
  ENST ID: ENST00000551244
  CDS Start-End: 101-1363
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105988 - DNA, 665 bp, Homo sapiens; identical to SEQ ID NO: 105983
  Payload ID: 779
  Gene Symbol: AGER
  Gene Name: advanced glycosylation end product-specific receptor
  ENST ID: ENST00000547213
  CDS Start-End: 264-665

SEQ ID NO: 105989 - DNA, 1493 bp, Homo sapiens
  Payload ID: 779
  Gene Symbol: AGER
  Gene Name: advanced glycosylation end product-specific receptor
  Uniprot ID: Q15109
  ENST ID: ENST00000550562
  CDS Start-End: 101-1192
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105990 - DNA, 487 bp, Homo sapiens; identical to SEQ ID NO: 105985
  Payload ID: 779
  Gene Symbol: AGER
  Gene Name: advanced glycosylation end product-specific receptor
  ENST ID: ENST00000548959
  CDS Start-End: 101-487

SEQ ID NO: 105991 - DNA, 1538 bp, Homo sapiens
  Payload ID: 779
  Gene Symbol: AGER
  Gene Name: advanced glycosylation end product-specific receptor
  Uniprot ID: Q15109
  ENST ID: ENST00000549758
  CDS Start-End: 101-1363
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105992 - DNA, 1463 bp, Homo sapiens
  Payload ID: 779
  Gene Symbol: AGER
  Gene Name: advanced glycosylation end product-specific receptor
  ENST ID: ENST00000552621
  CDS Start-End: 404-1288
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105993 - DNA, 487 bp, Homo sapiens; identical to SEQ ID NO: 105985
  Payload ID: 779
  Gene Symbol: AGER
  Gene Name: advanced glycosylation end product-specific receptor
  ENST ID: ENST00000551684
  CDS Start-End: 101-487

SEQ ID NO: 105994 - DNA, 737 bp, Homo sapiens
  Payload ID: 779
  Gene Symbol: AGER
  Gene Name: advanced glycosylation end product-specific receptor
  ENST ID: ENST00000552209
  CDS Start-End: 101-562
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 105995 - DNA, 665 bp, Homo sapiens; identical to SEQ ID NO: 105983
  Payload ID: 779
  Gene Symbol: AGER
  Gene Name: advanced glycosylation end product-specific receptor
  ENST ID: ENST00000547770
  CDS Start-End: 264-665

SEQ ID NO: 105996 - DNA, 1463 bp, Homo sapiens; identical to SEQ ID NO: 105992
  Payload ID: 779
  Gene Symbol: AGER
  Gene Name: advanced glycosylation end product-specific receptor
  ENST ID: ENST00000547155
  CDS Start-End: 404-1288

SEQ ID NO: 105997 - DNA, 737 bp, Homo sapiens; identical to SEQ ID NO: 105994
  Payload ID: 779
  Gene Symbol: AGER
  Gene Name: advanced glycosylation end product-specific receptor
  ENST ID: ENST00000549839
  CDS Start-End: 101-562

SEQ ID NO: 105998 - DNA, 487 bp, Homo sapiens
  Payload ID: 779
  Gene Symbol: AGER
  Gene Name: advanced glycosylation end product-specific receptor
  ENST ID: ENST00000548935
  CDS Start-End: 101-487
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagtttgagaaccttcacaattacagcctctga

SEQ ID NO: 105999 - DNA, 1538 bp, Homo sapiens; identical to SEQ ID NO: 105991
  Payload ID: 779
  Gene Symbol: AGER
  Gene Name: advanced glycosylation end product-specific receptor
  Uniprot ID: Q15109
  ENST ID: ENST00000547328
  CDS Start-End: 101-1363

SEQ ID NO: 106000 - DNA, 1538 bp, Homo sapiens; identical to SEQ ID NO: 105991
  Payload ID: 779
  Gene Symbol: AGER
  Gene Name: advanced glycosylation end product-specific receptor
  Uniprot ID: Q15109
  ENST ID: ENST00000551381
  CDS Start-End: 101-1363

SEQ ID NO: 106001 - DNA, 737 bp, Homo sapiens
  Payload ID: 779
  Gene Symbol: AGER
  Gene Name: advanced glycosylation end product-specific receptor
  ENST ID: ENST00000548034
  CDS Start-End: 101-562
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 106002 - DNA, 1493 bp, Homo sapiens; identical to SEQ ID NO: 105986
  Payload ID: 779
  Gene Symbol: AGER
  Gene Name: advanced glycosylation end product-specific receptor
  ENST ID: ENST00000551378
  CDS Start-End: 101-1192

SEQ ID NO: 106003 - DNA, 1493 bp, Homo sapiens; identical to SEQ ID NO: 105989
  Payload ID: 779
  Gene Symbol: AGER
  Gene Name: advanced glycosylation end product-specific receptor
  Uniprot ID: Q15109
  ENST ID: ENST00000551827
  CDS Start-End: 101-1192

SEQ ID NO: 106004 - DNA, 1463 bp, Homo sapiens
  Payload ID: 779
  Gene Symbol: AGER
  Gene Name: advanced glycosylation end product-specific receptor
  ENST ID: ENST00000550885
  CDS Start-End: 404-1288
ctgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacagctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagcccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 106005 - DNA, 1463 bp, Homo sapiens; identical to SEQ ID NO: 105992
  Payload ID: 779
  Gene Symbol: AGER
  Gene Name: advanced glycosylation end product-specific receptor
  ENST ID: ENST00000550196
  CDS Start-End: 404-1288

SEQ ID NO: 106006 - DNA, 737 bp, Homo sapiens; identical to SEQ ID NO: 106001
  Payload ID: 779
  Gene Symbol: AGER
  Gene Name: advanced glycosylation end product-specific receptor
  ENST ID: ENST00000552991
  CDS Start-End: 101-562

SEQ ID NO: 106007 - DNA, 1493 bp, Homo sapiens; identical to SEQ ID NO: 105989
  Payload ID: 779
  Gene Symbol: AGER
  Gene Name: advanced glycosylation end product-specific receptor
  Uniprot ID: Q15109
  ENST ID: ENST00000551254
  CDS Start-End: 101-1192

SEQ ID NO: 106008 - DNA, 1463 bp, Homo sapiens; identical to SEQ ID NO: 105992
  Payload ID: 779
  Gene Symbol: AGER
  Gene Name: advanced glycosylation end product-specific receptor
  ENST ID: ENST00000549168
  CDS Start-End: 404-1288

SEQ ID NO: 106009 - DNA, 665 bp, Homo sapiens; identical to SEQ ID NO: 105983
  Payload ID: 779
  Gene Symbol: AGER
  Gene Name: advanced glycosylation end product-specific receptor
  ENST ID: ENST00000549776
  CDS Start-End: 264-665

SEQ ID NO: 106010 - DNA, 665 bp, Homo sapiens; identical to SEQ ID NO: 105983
  Payload ID: 779
  Gene Symbol: AGER
  Gene Name: advanced glycosylation end product-specific receptor
  ENST ID: ENST00000551677
  CDS Start-End: 264-665

SEQ ID NO: 106011 - DNA, 1493 bp, Homo sapiens; identical to SEQ ID NO: 105989
  Payload ID: 779
  Gene Symbol: AGER
  Gene Name: advanced glycosylation end product-specific receptor
  Uniprot ID: Q15109
  ENST ID: ENST00000547651
  CDS Start-End: 101-1192

SEQ ID NO: 106012 - DNA, 1538 bp, Homo sapiens; identical to SEQ ID NO: 105987
  Payload ID: 779
  Gene Symbol: AGER
  Gene Name: advanced glycosylation end product-specific receptor
  ENST ID: ENST00000549227
  CDS Start-End: 101-1363

SEQ ID NO: 106013 - DNA, 1463 bp, Homo sapiens; identical to SEQ ID NO: 106004
  Payload ID: 779
  Gene Symbol: AGER
  Gene Name: advanced glycosylation end product-specific receptor
  ENST ID: ENST00000546535
  CDS Start-End: 404-1288

SEQ ID NO: 106014 - DNA, 737 bp, Homo sapiens; identical to SEQ ID NO: 106001
  Payload ID: 779
  Gene Symbol: AGER
  Gene Name: advanced glycosylation end product-specific receptor
  ENST ID: ENST00000549626
  CDS Start-End: 101-562

SEQ ID NO: 106015 - DNA, 737 bp, Homo sapiens; identical to SEQ ID NO: 106001
  Payload ID: 779
  Gene Symbol: AGER
  Gene Name: advanced glycosylation end product-specific receptor
  ENST ID: ENST00000550959
  CDS Start-End: 101-562

SEQ ID NO: 106016 - DNA, 487 bp, Homo sapiens; identical to SEQ ID NO: 105998
  Payload ID: 779
  Gene Symbol: AGER
  Gene Name: advanced glycosylation end product-specific receptor
  ENST ID: ENST00000548009
  CDS Start-End: 101-487

SEQ ID NO: 106017 - DNA, 1538 bp, Homo sapiens; identical to SEQ ID NO: 105991
  Payload ID: 779
  Gene Symbol: AGER
  Gene Name: advanced glycosylation end product-specific receptor
  Uniprot ID: Q15109
  ENST ID: ENST00000548464
  CDS Start-End: 101-1363

SEQ ID NO: 106018 - DNA, 487 bp, Homo sapiens; identical to SEQ ID NO: 105985
  Payload ID: 779
  Gene Symbol: AGER
  Gene Name: advanced glycosylation end product-specific receptor
  ENST ID: ENST00000550854
  CDS Start-End: 101-487

SEQ ID NO: 106019 - DNA, 737 bp, Homo sapiens
  Payload ID: 779
  Gene Symbol: AGER
  Gene Name: advanced glycosylation end product-specific receptor
  ENST ID: ENST00000620802
  CDS Start-End: 101-562
ctgaaagatgggggctggagagagggtgcaggccccacctagggcggaggccacagcagggagaggggcagacagagccaggaccctggaaggaagcaggatggctgccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacatcttgc

SEQ ID NO: 106020 - DNA, 2891 bp, Homo sapiens
  Payload ID: 780
  Gene Symbol: AVIL
  Gene Name: advillin
  Uniprot ID: O75366
  ENST ID: ENST00000257861
  CDS Start-End: 432-2891
agagtgtgatcttgtacaagttattcagcctttgcaaacctcagattcacacaatgtaagatgaagaaactcaccttctgaaaattagagataacatatgcaaagtgaatcaatacagggcttaacatatttatcacccctttggtaaataaccatgacgattaccagagctcttaagggcaatggcaggtgggaagcagaactcatgggtggtaatccccaggccagccaggctcaccatgtgcacttggacaagtccttgcccccatcattgtgaaatggtgcagggatgcaccatgagggtgtggcaggatggctgacaacagactgggaagcagctcggcagaaaaactggattgatgcccactatggcaagagatatcatctcccctcttgttctgtgatgtttcagtcctggaaagacaagcatcatgcctctgaccagtgccttcagggctgtggacaacgaccctgggatcattgtctggagaatagagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctaaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtgttcttgtggattggggctgaggccaatgccacggagaaggagagtgcccttgccacagcacagcagtacctgcacactcaccccagcggccgagatcccgacacaccaatcctgatcattaagcaggggtttgagcctcccatcttcacaggctggttcctagcctgggaccctaacatttggagtgcaggaaaaacatatgaacaattaaaagaagagctgggagatgctgctgctatcatgcgaatcactgctgacatgaagaatgcaaccctctccctgaattctaatgacagtgagccaaaatattaccctatagcagttctgttgaaaaaccagaatcaggagctgcctgaggatgtaaaccctgccaaaaaggagaattacctctctgaacaggactttgtgtctgtgtttggcatcacaagagggcaatttgcagctctgcctggctggaaacagctccaaatgaagaaagaaaaggggcttttctaa

SEQ ID NO: 106021 - DNA, 568 bp, Homo sapiens
  Payload ID: 780
  Gene Symbol: AVIL
  Gene Name: advillin
  ENST ID: ENST00000549994
  CDS Start-End: 96-568
gctttggagtggttcttcaatactgctgctgcttacgcgccgggaaactgggaaggctggtgagcgagaaggcaagtcctggaaagacaagcatcatgcctctgaccagtgccttcagggctgtggacaacgaccctgggatcattgtctggagaatagagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaa

SEQ ID NO: 106022 - DNA, 2735 bp, Homo sapiens
  Payload ID: 780
  Gene Symbol: AVIL
  Gene Name: advillin
  ENST ID: ENST00000549851
  CDS Start-End: 19-249
cctggaaagacaagcatcatgcctctgaccagtgccttcagggctgtggacaacgaccctgggatcattgtctggagaatagaggaaacaccctggaaagacaggtgggacctactcagcagactcctggcagcttccatcagagaaatggaacatgtcttccacggggcaccctggctcctacaaaatatggggagagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctaaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtgttcttgtggattggggctgaggccaatgccacggagaaggagagtgcccttgccacagcacagcagtacctgcacactcaccccagcggccgagatcccgacacaccaatcctgatcattaagcaggggtttgagcctcccatcttcacaggctggttcctagcctgggaccctaacatttggagtgcaggaaaaacatatgaacaattaaaagaagagctgggagatgctgctgctatcatgcgaatcactgctgacatgaagaatgcaaccctctccctgaattctaatgacagtgagccaaaatattaccctatagcagttctgttgaaaaaccagaatcaggagctgcctgaggatgtaaaccctgccaaaaaggagaattacctctctgaacaggactttgtgtctgtgtttggcatcacaagagggcaatttgcagctctgcctggctggaaacagctccaaatgaagaaagaaaaggggcttttctaaagcaagaaggcctatacctattgcaaggccacagaaaagagcagatagtgccaatatcaggaaataatttatccaccaatttctgcctgacattcagctacttaatttagatataatagagtctgcaaatcacggcatgttc

SEQ ID NO: 106023 - DNA, 4081 bp, Homo sapiens
  Payload ID: 781
  Gene Symbol: AEBP1
  Gene Name: AE binding protein 1
  Uniprot ID: Q8IUX7
  ENST ID: ENST00000223357
  CDS Start-End: 306-3782
cggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacagacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 106024 - DNA, 618 bp, Homo sapiens
  Payload ID: 781
  Gene Symbol: AEBP1
  Gene Name: AE binding protein 1
  ENST ID: ENST00000434445
  CDS Start-End: 1-315
aggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagca

SEQ ID NO: 106025 - DNA, 2571 bp, Homo sapiens
  Payload ID: 781
  Gene Symbol: AEBP1
  Gene Name: AE binding protein 1
  Uniprot ID: Q8IUX7
  ENST ID: ENST00000450684
  CDS Start-End: 69-2270
ttttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccgtgagtgtggagggctggcaggggctctgagtggaggtggggtgctagggtgggccagccggcacccagctaaagacaaccccgcctcccttgcagctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggcacg

SEQ ID NO: 106026 - DNA, 665 bp, Homo sapiens
  Payload ID: 781
  Gene Symbol: AEBP1
  Gene Name: AE binding protein 1
  ENST ID: ENST00000453052
  CDS Start-End: 1-210
aagcccgatgctgagcgccagacagacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaggccattgtgcagacggtccccatctggatgacatctgtggctgcgccctgggggagctctacctgtgatttcacgtgtgtcccctgagagctgggcatggtcagcccgttctccagatggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaaggatggagctagtgagccaccattctggggtacgcgtcctcagagtgtccccccattgggatggagtcacaccgtattgaggacaaccagatccgagcctcctccatgctgcgccacggcctgggggcacagcgcggccggctcaacatgcagaccggtgccactgaggacg

SEQ ID NO: 106027 - DNA, 566 bp, Homo sapiens
  Payload ID: 781
  Gene Symbol: AEBP1
  Gene Name: AE binding protein 1
  ENST ID: ENST00000449162
  CDS Start-End: 80-566
agatgctcctccaggcctggatggctcagtcacctctctgccccttctgtgcccagaacagaatagtggaggagtggatatgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggact

SEQ ID NO: 106028 - DNA, 2172 bp, Homo sapiens
  Payload ID: 781
  Gene Symbol: AEBP1
  Gene Name: AE binding protein 1
  ENST ID: ENST00000413907
  CDS Start-End: 1-200
atttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggtgagggtctgtgggggccagcagctggcctctgctgctgatgtgcagagctcactgcctcccgcctgttccggagcctctctggggattctggcttgtcttacagggccctaggagccccagctgtcccccagaccctcgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggc

SEQ ID NO: 106029 - DNA, 751 bp, Homo sapiens
  Payload ID: 781
  Gene Symbol: AEBP1
  Gene Name: AE binding protein 1
  ENST ID: ENST00000455443
  CDS Start-End: 1-751
agagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagcctcctgtgaagcctctgctgcccccgctgccccctgactatggtgatggttacgtgatccccaactacgatgacatggactattactttgggcctcctccgccccagaagcccgatgctgagcgccagacagacgaagagaaggaggagctgaagaaacccaaaaaggaggacagcagccccaaggaggagaccgacaagtgggcagtg

SEQ ID NO: 106030 - DNA, 783 bp, Homo sapiens
  Payload ID: 781
  Gene Symbol: AEBP1
  Gene Name: AE binding protein 1
  ENST ID: ENST00000431035
  CDS Start-End: 1-165
ctcatgaaggtggtgaacgaggagtgccccaccatcacccgcacttacagcctgggcaagagctcacgaggcctcaagatctatgccatggagatctcagacaaccctggggagcatgaactgggtgagggtctgtgggggccagcagctggcctctgctgctgatgtgcagagctcactgcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctggg

SEQ ID NO: 106031 - DNA, 3620 bp, Homo sapiens
  Payload ID: 782
  Gene Symbol: AEBP2
  Gene Name: AE binding protein 2
  Uniprot ID: Q6ZN18
  ENST ID: ENST00000266508
  CDS Start-End: 2-1513
catggccgccgctatcaccgacatggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctgtgaatgaagtagactcttcggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcaca

SEQ ID NO: 106032 - DNA, 2533 bp, Homo sapiens
  Payload ID: 782
  Gene Symbol: AEBP2
  Gene Name: AE binding protein 2
  Uniprot ID: Q6ZN18
  ENST ID: ENST00000360995
  CDS Start-End: 125-1030
aactctcctttccccgccctctttcccctcggcgcttcgctcctcacggacctcaggacggctctaactcggaaacagtccccaaacgggcccagatcctctggcggagcagaagagggccttgatgtacacacgtcggtactcaagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcac

SEQ ID NO: 106033 - DNA, 722 bp, Homo sapiens
  Payload ID: 782
  Gene Symbol: AEBP2
  Gene Name: AE binding protein 2
  ENST ID: ENST00000398731
  CDS Start-End: 1-423
ctggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagagatggagtttcactcttgttgcccaggctggtgtgcaatggcgcgatcttggctcaccgcaacctccgcttcccgggttcaagcgattcttctgcctcagcttcctgagtagctgggattaaagacacccgccaccacgcccagctaattttgtattttaagtagagacggggtttcaccatattgaccaggctggtctcaaactcccgacctcaggtgatctgcccacctcggcctcccaaagtgctgagattacaggcgtgagccaccgtgcccagccaagtttaatttttacaccaatgattcatttctgcttttacaggtgattactttatctcactagaaaaaaaaaatgtaaaaatctaaacaaaaagtgtccaaaacttacaataagccttaatctcgaataattaccatgaca

SEQ ID NO: 106034 - DNA, 5099 bp, Homo sapiens
  Payload ID: 782
  Gene Symbol: AEBP2
  Gene Name: AE binding protein 2
  Uniprot ID: Q6ZN18
  ENST ID: ENST00000398864
  CDS Start-End: 27-1580
gaggaggaggaggagcaggcgccgccatggccgccgctatcaccgacatggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattt

SEQ ID NO: 106035 - DNA, 975 bp, Homo sapiens
  Payload ID: 782
  Gene Symbol: AEBP2
  Gene Name: AE binding protein 2
  ENST ID: ENST00000541908
  CDS Start-End: 76-900
ttcgccgcacttcccgctcgaccctcggttctggacaacggagatcgtccccagtcaagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaa

SEQ ID NO: 106036 - DNA, 518 bp, Homo sapiens
  Payload ID: 782
  Gene Symbol: AEBP2
  Gene Name: AE binding protein 2
  ENST ID: ENST00000538425
  CDS Start-End: 189-518
aaagcaagggcaaccagctccttcgccgcacttcccgctcgaccctcggttctggacaacggagatcgtccccagtcaaggtgattatatcgcagatctcacttgggagcttctcttaacctgtgaccatcgcctgagttagctggccgacttcccagcggtcctttgtgagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagcttt

SEQ ID NO: 106037 - DNA, 507 bp, Homo sapiens
  Payload ID: 782
  Gene Symbol: AEBP2
  Gene Name: AE binding protein 2
  ENST ID: ENST00000512223
  CDS Start-End: 1-393
ttagcacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtcagacaagcctttcaccttctgccatgattgtgaggcctcctcagccatgtgaaactgtgagtccattcaacctctttttctttataaattacccagtcttgggtatatttttatcagcaatgtgagaagggactaattctggtatgattaaaatattttgtgcttt

SEQ ID NO: 106038 - DNA, 2635 bp, Homo sapiens
  Payload ID: 783
  Gene Symbol:
  Gene Name: AF011889.5
  ENST ID: ENST00000422081
  CDS Start-End: 1413-2432
tcggagttcagccaccttagcaagtcctgggtttgttcttcagattttgctgctcgcccattgcctggatcgggggctactttgtaaaccaccaggaagactccagtgtttctgcttaatttttagatgtttgttaattgctcttggcctctcattaatcccctgtgggtcatccaggaaatatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgctcagaaaaggtgccctggagaatgggtgcgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaagataattctaacatctttgtcatcagtgttgacatctcttgattgtatcctgtcattccatttgagatcttcctggttctggctggcatcctctgacatcactccagcagaagaaagggaaggaacacgctgcattactgcgtgggatatcttctaaccataccgatgattctccgtatagctggtcttttccaccttatcatccttcctctgagaagtatgaaaacactaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggt

SEQ ID NO: 106039 - DNA, 375 bp, Homo sapiens
  Payload ID: 784
  Gene Symbol:
  Gene Name: AF111168.2
  ENST ID: ENST00000623612
  CDS Start-End: 1-375
atgactcttaaggagcatgctgccttcaagcatctgtttaacaaagcacatcttgcaccgcccttaatccattcaaccctgagtggatacagcacatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatcttttccccacccttcccccctttctattccacaaaaccgccattgtcatcatggcccgttctcaatgagctgttgggtacacctcccagacggggtggtggctgggcagaggggctcctcacttcccagtag

SEQ ID NO: 106040 - DNA, 1569 bp, Homo sapiens
  Payload ID: 785
  Gene Symbol:
  Gene Name: AF131216.1
  ENST ID: ENST00000622929
  CDS Start-End: 699-1061
cttgtcgatggcgtcgatgtttgaatggaggagccacagctcctccgtattgtcctgccgggaggacaggatcaagtggtggcccgtcaggcacagggtgccctcgacagccgggtagaaaggccggtgcagcaccacattgtccacccgcggggtcttaatcagctccgcaaactccatgctcccccgcggccggagccagggaaccgagcccggtaggtgcgaggcggttaccccgccgcagggaagtagcggaaacacccggcgcggggctggcccgtggggcggggcgggccgggcggtgaggctgggcccgccccaggctgggtgggcgcggcgaggcctacagccgccggcaccggccgcggggagacaggggctggggctggacgaggcccaagcgcctctcccgcaccgcgcggttcaccaggcctaggactcggccacagagaacccctctccacaggcccaaggaccgccgctgccgttgggctccgggtcccgcgttggcaagcggagggcagtaggagaaagccgcctcagaatccgcttccacgccctggccgctagggactcctagcggaagtggctactcgctgctggagcccacaacaactccgggcggaagcagcaggtctcgaaactcggaagacgcggaagtcgcagccggaagttggtcctcgctaggtcctctggaaatgcctccggaaacacagccagaccagaagatgtgtgttcctacgagaaaaaaagcttgtctttgccttcacgccctcccgctgcctttcttaaccacctacaaatattccttatcagaagaggtccgggaagagggaggaggtccctgtcttgccttcctccgcttgagtagtatcccctccagaagctcttcagagcgtggggctgctgtaaattgtgataattgttatgcattagccctgaagacatggcaagtaggggatggaggcggtgactgtgaccttacggaatcctccaggggtcagggagggacacagggccactccacaggctctccgagagcgccgcgccacgaggtgtaacctggagcaagaaagaggaaaaacaggaatacctgtgagaggaacccaagtacatgcagtgcacagaagagcaagtcacttgacttgctggcggccaccccgttaatctgcagcagagcctggacttcagtctgcatctgtgaaacccagcgcatgggtgcgttggtcaccaccgcacagcctccccgtcagacacccacgtttcgccaaaaatttattcaaataattactcctttgcttgttcctttcccaccgcccacttctgacatttttattcaaaagtaggaaatagaagagaaatatgtttgagtgctggtctgctgtgacttcattgaccttttaaatcctcaccatctagtacctaagcacagcgagttggacaaactctcacagtattcacaaagtaaattgccacaacctcatcagctcatccaacacttgtccatgcttttgattttgtccttcttaaaatgtacccttcttaaaataaaccactttatagacttgt

SEQ ID NO: 106041 - DNA, 808 bp, Homo sapiens
  Payload ID: 786
  Gene Symbol:
  Gene Name: AF165138.7
  ENST ID: ENST00000400562
  CDS Start-End: 51-548
ggcaatcatatttttcaaagcagggcaacaagagagtgaagctggtcaaaatgaatcttttctgcatttcgctggagggctctatggatagcttatatgagccaatcccagagcaacaagctaaccaagaaaacatgtctagtagaactgattctcctatcccaccctttggagagagtgaacaaacaccaaacaatctcttcgtgggagtttctaatttagagaatgcaaaaccaaaaaagagaaagttattccggagatttatgtctgaaaataaaatatttgaaggaaaaactgtgaatgacaaaatctggcaggaacacagcaagcataagaatgattcccacatcagaaggccctgtcagctaaaagatctaaatgaagatgattttctaagtaacaacatacatacctatcaaggaaaaactctacaaggaacttcctatcaggtgacctctgaatgttggagtccatttcactatcaaagacatgttgagaccactgttgatgaactggtgagacatttcttcccagatgtaactatttaagtggatttcccatctcttttccactcattttaatgccacaagcactgttttctatagttctttattacttctgttttcagctgccacatggaagtgtttctaaagaacataaatagaggcttgtccttactgagtggttttctgaactaaaaggaacataaagcatttccttcaaagaaggaaaggttgttatataaaaaattttccctaaaatttagcaatttttcctgagataggaaaaaatttataatgttaaaaag

SEQ ID NO: 106042 - DNA, 1151 bp, Homo sapiens
  Payload ID: 786
  Gene Symbol:
  Gene Name: AF165138.7
  ENST ID: ENST00000435732
  CDS Start-End: 1-459
gagggctctatggatagcttatatgagccaatcccagagcaacaagctaaccaagaaaacatgtctagtagaactgattctcctatcccaccctttggagagagtgaacaaacaccaaacaatctcttcgtgggagtttctaatttagagaatgcaaaaccaaaaaagagaaagttattccggagatttatgtctgaaaataaaatatttgaaggaaaaactgtgaatgacaaaatctggcaggaacacagcaagcataagaatgattcccacatcagaaggccctgtcagctaaaagatctaaatgaagatgattttctaagtaacaacatacatacctatcaaggaaaaactctacaaggaacttcctatcaggtgacctctgaatgttggagtccatttcactatcaaagacatgttgagaccactgttgatgaactggctcaagaatttatgtaaagtaacaaaagaagatacttatgtagtcaaatgtccccaaggatatttgaggaacaatgaattcctgtgatccaatccttcaatttaaagatgaagggctgaagtgcagagaggagaagtggctcactcaagttcacatggccagtcacaaagcagattttcaaagcagaacaatcattagtcggcacacaagggcaggttcttactctaggttttcttaacatttcttgtgtatatgaaataaatattagataaaaatgtttttttactgtgtaattttccattcatagctcctcttcttgctaagaatccaatagatacttaataaaaattaattaatttgcatactggctcttaaatttcctattgttcataatttttggtcagctaggaggtgtacccagaaacagaaatgttcttatgagtagttctagaaacttcttcaaaatttcagagcagaggatattacgcaggaagtaagaaagatgtggcttctgtggccttttctcttaaatcaacacaacccccatttgcaatgctggtttgtgtaatcctggcaactcccagctagcttggcagtgtgtccacattcaaagactgacccaaagctataggtcagtgagcaaaaagcagtcttggcttcccctgcagaagtggagaaatggcagtgacattgcgacttcattatacta

SEQ ID NO: 106043 - DNA, 9390 bp, Homo sapiens
  Payload ID: 787
  Gene Symbol: AFF1
  Gene Name: AF4/FMR2 family, member 1
  Uniprot ID: P51825
  ENST ID: ENST00000307808
  CDS Start-End: 421-4053
ggcaatttcttttcctttctaactgtggcccgcgttgtgctgttgctgggcaggcgttgggcgccggcggtcttcgagcgtgggggcccgctggctttcccttctcagaaactgcgccgggggcgctcgcttgccccggattcggacgcggcgctccccgggctcgtctgaagtgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatc

SEQ ID NO: 106044 - DNA, 9285 bp, Homo sapiens
  Payload ID: 787
  Gene Symbol: AFF1
  Gene Name: AF4/FMR2 family, member 1
  Uniprot ID: P51825
  ENST ID: ENST00000395146
  CDS Start-End: 276-3932
gagcttgccagccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaactcatgttgtccagccaactcagagtttcgtcagtgaacaagaaacatgaaatctgcttcttagagaggctatatttttctgctacaaatattttatatttatagcaaaactagactttcagagtccttgattgtctaggggaagttaactccctgagaggatgtagagatttggggtggttgattagacttttgaaaaactcatcaccacatgccttcactccagagtgttctcagctagatttgatttggttgaggaggaactgtggccctccgtaagttattgccatagtgtatgcattaaaccaagtccattttgaatgacctaaaatgaagtaacacaatcagaaatcccatgtgcccataagcacagatttttctttttcattgaaactttaaaggttattattggaaacattactttgagtgcagtgtttttaaaagccaattcttttttatcccttttagaagtagaatttgcacacttactacaattgaggagtgtcatctctataactttttctccgcctttgtcccattctgcccctgtacatgtttcctaccaagcatgtttcacattttcctattagtggaggagggagaaccatatttatttataatgaagacatctaagatccctatgatgaatgcaggaactctcttggtagtttgtaaatacacaaagggatgtgtcgagggatgggagcgatgcttatctctcacagtgtgagtggtctgtgtgaggctgttccttcagtttcttctccagactgttctttggttgtcactaagtcagaggtctggtccctcatgtttaggtgaaagccagagaatgacagctgtagtcatatctgagcataagaccttgatgtgtgattcctgatgaccggtttcatttattcatgttataaagcaaagccctggtcctttttaaactactagttttaaaaacctgtgttaaatgaacagtaattgcctggtaggtttggtgtgtgtgtagcattgtgtgtccatctgttatatgtaaaggacaaggcaccagaatcaggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccctcctgttcttgagccagttgtctcttttgttttgggtcccacttaggattaatggatgtaaggtattttcctgtgcctttattttgtgtcattctattggaaggaggtgtaacggcagaatagcatcgtgttgggggttttccttcaaacactgcaagtgatattgccaccatgtgaacctcaaatatgcaatccagttgtgttggtttctcggtgacttggagtgttcatctcttcatgaattgtgagcactgaccatgttcttcagttcttaattatggtgagttgacaaataccaactactgcttttctttaggtggctataaatttcttactgtcaggaggaaatgacattatattctgttccactgaacgtcagagatcagcaggcactgtactgggtagagaagtgcctatacttctctacctaagagggcaggagggaaaccctacagctccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcattggggttgaatcca

SEQ ID NO: 106045 - DNA, 1478 bp, Homo sapiens
  Payload ID: 787
  Gene Symbol: AFF1
  Gene Name: AF4/FMR2 family, member 1
  ENST ID: ENST00000503477
  CDS Start-End: 228-1478
actcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaa

SEQ ID NO: 106046 - DNA, 638 bp, Homo sapiens
  Payload ID: 787
  Gene Symbol: AFF1
  Gene Name: AF4/FMR2 family, member 1
  ENST ID: ENST00000511722
  CDS Start-End: 228-638
cgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaa

SEQ ID NO: 106047 - DNA, 582 bp, Homo sapiens
  Payload ID: 787
  Gene Symbol: AFF1
  Gene Name: AF4/FMR2 family, member 1
  ENST ID: ENST00000514970
  CDS Start-End: 1-582
acagtcagcatttcctttaatgcggtggttccctctggtctcggcccgagttctcatgccaggcagcggcagctgtggtaccaactgcctgggagccccgtggcgctgttgcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccg

SEQ ID NO: 106048 - DNA, 463 bp, Homo sapiens
  Payload ID: 787
  Gene Symbol: AFF1
  Gene Name: AF4/FMR2 family, member 1
  ENST ID: ENST00000511442
  CDS Start-End: 307-463
agtctgagaggcgtggagaattttgcttgtgcaagattatttcagagcaaggtcgtgcggtgtgtgtagaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtcc

SEQ ID NO: 106049 - DNA, 1486 bp, Homo sapiens
  Payload ID: 787
  Gene Symbol: AFF1
  Gene Name: AF4/FMR2 family, member 1
  ENST ID: ENST00000507468
  CDS Start-End: 267-1486
agccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaagatgaacagactagccactttgcattgactggaaacaatggcatttacagaaagagtcaacagcagtggcaacagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaa

SEQ ID NO: 106050 - DNA, 3644 bp, Homo sapiens
  Payload ID: 787
  Gene Symbol: AFF1
  Gene Name: AF4/FMR2 family, member 1
  ENST ID: ENST00000544085
  CDS Start-End: 13-3630
ataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctccaaaagtgccagcagtaccaagagcaaccacagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagccaaatgtgtgcaccttggccctcaacagcagtttggtggacctggtgcactatacacgacagggttttcagcagctacaagaattaaccaaaacaccttaa

SEQ ID NO: 106051 - DNA, 12280 bp, Homo sapiens
  Payload ID: 788
  Gene Symbol: AFF2
  Gene Name: AF4/FMR2 family, member 2
  Uniprot ID: P51816
  ENST ID: ENST00000286437
  CDS Start-End: 91-2949
agttttggttgtggcaacccagaggaaggttgcagtggcccatctatctatcccagatgtaagatatgcttcacccctctttcttgatccatgaagttcaaaaggaggcaccaagcatttccgtccttcttcaagatgaaggtaagccttcccagtgatccaagctgtgttgaagaaatcttgcgggaatcgcagcatctgaccccaggattcaccttacaaaagtggaatgacccaaccaccagagcttctacaaagtcagtgtctttcaaatcgatgcttgaggatgacctgaagctgagcagtgatgaagatgaccttgagcctgtgaagaccttgaccactcagtgcactgccactgagctctaccaggctgttgaaaaggcaaaacctaggaataatcctgtgaacccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaagccaatagaagttgcagagaagatccctgagaagaagcagcgcctggaggaggccacaactatctgcttgctccctccttgcatctcaccagccccaccccacaagcctcccaacactagagaaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcggttcacaatgctgattattacatgcaagaagctaagaagctgaagcacaaagctgatgcactgttcgagaaatttggcaaagctgtgaattatgctgatgccgccctctccttcactgaatgtggcaatgccatggaacgcgaccctctggaagcaaagtccccatacaccatgtactctgagactgtggagctcctcaggtatgcaatgaggctgaagaactttgcaagtcccttggcttcggatggggacaaaaagctagcagtactatgctaccgatgtttatcactcctctatttgagaatgtttaagctgaagaaggaccatgctatgaagtactccagatcactgatggaatattttaagcaaaatgcttcaaaagtcgcacagataccctctccatgggtaagcaatggaaagaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggcgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagaaatcctctttgggatcagaagatacctaaaattctccccttttgcccacttggttagatgagtgatatattctttggatcctgcaaagaagagattggtttattttcttttctggtggtggtagtggttgtatctgtggctgtgatggttgttgttacttgtctctctctctctctggctctggcttttgctttcctgctagtgttctttctctttccaaacaaatagttaaattaaatgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacacacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcaactggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctca
